US008563710B2

(12) United States Patent  
Liang

(10) Patent No.: US 8,563,710 B2  
(45) Date of Patent: Oct. 22, 2013

(54) MODIFIED OLIGONUCLEOTIDE AND ITS PREPARATION AND APPLICATION

(75) Inventor: Zicai Liang, Beijing (CN)

(73) Assignee: Biomics Biotechnologies Co., Ltd., Nantong (CN)

( * ) Notice: Subject to any disclaimer, the term of this patent is extended or adjusted under 35 U.S.C. 154(b) by 0 days.

(21) Appl. No.: 13/262,702

(22) PCT Filed: Mar. 30, 2010

(86) PCT No.: PCT/CN2010/000405
§ 371 (c)(1),
(2), (4) Date: Nov. 30, 2011

(87) PCT Pub. No.: WO2010/111891
PCT Pub. Date: Oct. 7, 2010

(65) Prior Publication Data
US 2012/0088815 A1  Apr. 12, 2012

(30) Foreign Application Priority Data

Apr. 3, 2009  (CN) .......................... 2009 1 0081144  
Apr. 3, 2009  (CN) .......................... 2009 1 0081145

(51) Int. Cl.
C07H 21/04 (2006.01)

(52) U.S. Cl.
USPC ......... 536/24.5; 536/24.31; 536/24.1; 514/44

(58) Field of Classification Search
None
See application file for complete search history.

(56) References Cited

U.S. PATENT DOCUMENTS

| 2004/0192626 | A1 | 9/2004 | McSwiggen et al. | |
|---|---|---|---|---|
| 2006/0276421 | A1 | 12/2006 | Kunugiza et al. | |
| 2007/0160980 | A1* | 7/2007 | Haeberli et al. | ................... 435/5 |
| 2007/0197460 | A1 | 8/2007 | Fougerolles et al. | |

FOREIGN PATENT DOCUMENTS

| CN | 1663957 A | 9/2005 |
|---|---|---|
| CN | 1860228 A | 11/2006 |
| CN | 101370818 A | 2/2009 |
| WO | WO-2003/070918 A2 | 8/2003 |
| WO | WO-2007/031877 A2 | 3/2007 |
| WO | WO-2007/128477 A2 | 11/2007 |
| WO | WO-2008/152131 A2 | 12/2008 |

OTHER PUBLICATIONS

Napoli, C., et al., "Introduction of a Chimeric Chalcone Synthase Gene into Petunia Results in Reversible Co-Suppression of Homologous Genes in Trans," The Plant Cell, Apr. 1990, vol. 2, pp. 279-289.

Tosic, M., et al., "Post-Transcriptional Events are Responsible for Low Expression of Myelin Basic Protein in Myelin Deficient Mice: Role of Natural Antisense RNA," The EMBO Journal, Feb. 1990, vol. 9, No. 2, pp. 401-406.

Fire, A., et al., "Production of Antisense RNA Leads to Effective and Specific Inhibition of Gene Expression in C. Elegans Muscle," Development, Oct. 1991, vol. 113, No. 2, pp. 503-514.

Fire, A., et al., "Potent and Specific Genetic Interference by Double-Stranded RNA in Caenorhabditis Elegans," Nature, Feb. 19, 1998, vol. 391, No. 6669, pp. 806-811.

Liu, W.Y., et al., "Efficient RNA Interference in Zebrafish Embryos Using siRNA Synthesized with SP6 RNA Polymerase," Development, Growth & Differentiation, Jun. 2005, vol. 47, No. 5, pp. 323-331.

Elbashir, S.M., et al., "Duplexes of 21-Nucleotide RNAs Mediate RNA Interference in Cultured Mammalian Cells," Nature, May 24, 2001, vol. 411, No. 6836, pp. 494-498.

Hamilton, A.J., et al., "A Species of Small Antisense RNA in Post-transcriptional Gene Silencing in Plants," Science, Oct. 29, 1999, vol. 286, No. 5441, pp. 950-9522.

Kumiko, U. T., et al., "Thermodynamic Stability and Watson-Crick Base Pairing in the Seed Duplex are Major Determinants of the Efficiency of the siRNA-Based Off-Target Effect," Nucleic Acids Research, 2008, vol. 36, No. 22, pp. 7100-7109.

International Search Report in international application No. PCT/CN2010/000405, dated Jun. 17, 2010.

Judge et al., Design of Noninflammatory Synthetic siRNA Mediating Potent Gene Silencing in Vivo, Molecular Therapy, 13(3):494-505 (2006).

Kim et al., Immune activation by siRNA/liposome complexes in mice is sequence-independent: lack of a role for Toll-like receptor 3 signaling, Molecules and Cells, 24(2):247-54 (2007).

Ohrt et al., siRNA Modifications and Sub-Cellular Localization: A Question of Intracellular Transport? Current Pharmaceutical Design, 14(34):3674-85 (2008).

Prakash et al., Positional effect of chemical modifications on short interference RNA activity in mammalian cells, J. Medicinal Chemistry, 48(13):4247-53 (2005).

Schubert et al., Strand-specific silencing of a picornavirus by RNA interference: Evidence for the superiority of plus-strand specific siRNAs, Antiviral Research, 73(3):197-205 (2007).

Volkov et al., Selective Protection of Nuclease-Sensitive Sites in siRNA Prolongs Silencing Effect, Oligonucleotides,19(2):191-202 (2009).

Watts et al., Chemically modified siRNA: tools and applications, Drug Discovery Today, 13(19-20):842-55 (2008).

Supplementary European Search Report issued in connection with European Patent Application No. 10757994.8, dated May 22, 2013.

* cited by examiner

Primary Examiner — Kimberly Chong  
(74) Attorney, Agent, or Firm — Marshall, Gerstein & Borun LLP

(57) ABSTRACT

The present invention relates to a modified oligonucleotide, its preparation and application. The invention eables stabilizing the oligonucleotide by introducing a relatively small amount of modified nucleotide at specific UA/UA and/or CA/UG and/or UG/CA site of the oligonucleotide, therefore to decrease the modification-related cytotoxicity and compromising effects on the biological activity.

23 Claims, No Drawings

MODIFIED OLIGONUCLEOTIDE AND ITS PREPARATION AND APPLICATION

CROSS-REFERENCE TO RELATED APPLICATIONS

This is the U.S. national phase of International Application No. PCT/CN2010/000405, filed Mar. 30, 2010, which claims the benefit of Chinese Patent Application No. 200910081145.8, filed Apr. 3, 2009 and Chinese Patent Application No. 200910081144.3, filed Apr. 3, 2009.

FIELD OF THE INVENTION

This invention relates to nucleic acid technology, specifically to modified oligonucleotide and its preparation, its application in RNA interference, pharmaceutical compositions, and disease treatment.

BACKGROUND OF THE INVENTION

RNA interference (RNAi) is a gene silencing phenomenon mediated by double-stranded RNA (dsRNA) molecules, shutting down homologous gene expression at mRNA level. RNAi is a post-transcriptional gene regulation mechanism, also named post-transcriptional gene silencing (PTGS), target gene knockdown, or gene silencing.

RNAi phenomenon was first reported in plants by two different research groups in 1990. Later on, this phenomenon was further observed in almost all eukaryotes, including *C. elegans, Drosophila*, zebrafish and mice.

In 1999, RNA fragments of 21 to 25 nucleotides in length were identified in plant RNAi by Hamilton and Baulcombe. These small RNA fragments were demonstrated to be the mediator necessary for RNAi, and thus named as small interfering RNA (siRNA).

Double-stranded siRNA conjugates with endogenous enzymes and proteins, and then forms RNA-induced silencing complex (RISC). In the process of RNAi, while the sense RNA strand of double-stranded siRNA is excluded from the complex, the antisense RNA strand functions to guide RISC to target mRNA at homologous locus, resulting in the degradation of target mRNA and gene silencing mediated by RNase III component within RISC complex.

However, due to the vulnerability of siRNA to serum ribonuclease that resulting in serum instability, synthetic siRNAs are often chemically modified so as to increase their serum stability and gene silencing activity.

Even though, in consideration of the poor understanding of the degradation process and mechanism of RNAi, random modification strategy is performed to stabilize siRNA in body fluids. Although this strategy can improve serum stability of the modified siRNAs to some extent, it usually ends up with excessive chemical modifications and results in increased cytotoxicity and compromised biological activity in many cases, due to the lack of theoretical guidance. This therefore restricts the in vivo applications of the modified siRNAs. In addition, the extensive siRNA modification strategy also limits the use of many chemical modifications that have great stabilizing effect, however with relatively high cytotoxicity.

Therefore, there is an urgent need to develop a specific modification strategy for synthetic siRNAs, to achieve optimum serum stability with minimal chemical modifications.

SUMMARY OF THE INVENTION

The present invention is to overcome technical problem caused by the extensive siRNA modification commonly performed in the art, by providing a kind of modified oligonucleotide. The oligonucleotides provided in the present invention include, without limitation, RNA and DNA oligonucleotides, also include a variety of chemically modified nucleic acid derivatives including single-stranded and double-stranded nucleic acid molecules. That is, the modified oligonucleotides disclosed in the invention include but do not limit to single-stranded RNA molecules (ssRNA), single-stranded DNA molecule (ssDNA), double-stranded RNA molecules (dsRNA), double-stranded DNA molecule (dsDNA), as well as a variety of nucleic acid derivatives modified from the above molecules. Preferably, the oligonucleotides are double-stranded RNA molecules (dsRNA); more preferably, the oligonucleotides are small interfering nucleic acids (siRNA).

To address these problems, the present invention discloses a modified oligonucleotide comprising a first nucleic acid fragment and a second nucleic acid fragment. Said first nucleic acid fragment and second nucleic acid fragment can form double-stranded region, wherein the modified oligonucleotide has at least one of the following modifications, the modification(s) improve the stability of the modified oligonucleotide in mammalian body fluids:

(a) The first nucleic acid fragment contains at least one contiguous UA sequence, the second nucleic acid fragment contains at least one contiguous UA sequence complementary to the UA sequence in the first nucleic acid fragment. The UA sequence(s) of the first nucleic acid fragment and the complementary UA sequence(s) of the second nucleic acid fragment pair to form UA/UA site(s); wherein at least one of the nucleotides in at least one of the UA/UA site(s) is a modified nucleotide;

(b) The first nucleic acid fragment contains at least one contiguous CA or UG sequence, the second nucleic acid fragment contains at least one contiguous CA or UG sequence complementary to the CA or UG sequence in the first nucleic acid fragment, the CA or UG sequence(s) of the first nucleic acid fragment and the CA or UG sequence(s) of the second nucleic acid fragment pair to form CA/UG and/or UG/CA site(s); wherein at least one of the nucleotides in at least one of the CA/UG and/or UG/CA site(s) is a modified nucleotide;

(c) The first nucleic acid fragment contains at least one contiguous UA sequence and at least one contiguous CA or UG sequence, the second nucleic acid fragment contains at least one contiguous UA sequence complementary to the UA sequence of the first nucleic acid fragment and one contiguous CA or UG sequence complementary to the CA or UG sequence of the first nucleic acid fragment, the UA sequence(s) of the first nucleic acid fragment and the UA sequence(s) of the second nucleic acid fragment pair to form UA/UA site(s), the CA or UG sequence(s) of the first nucleic acid fragment and the UG or CA sequence(s) of the second nucleic acid fragment pair to form CA/UG or UG/CA site(s); wherein at least one of the nucleotides in at least one of the UA/UA site(s) is a modified nucleotide, and at least one of the nucleotides in at least one of the CA/UG or UG/CA site(s) is a modified nucleotide.

According to the present invention, in the cases that the first nucleic acid fragment contains at least one contiguous UA sequence, the second nucleic acid fragment contains at least one contiguous UA sequence complementary to the UA sequence in the first nucleic acid fragment, the UA sequence(s) of the first nucleic acid fragment and the complementary UA sequence(s) of the second nucleic acid fragment pair to form UA/UA site(s), modification can be made for at least one of the nucleotides in one UA/UA site, modification can also be made for at least one of the nucleotides in multiple UA/UA sites, modifications can also be made for multiple nucleotides in multiple UA/US sites. Preferably, only one uracil nucleotide is modified in each UA/UA site.

In the cases that first nucleic acid fragment contains at least one contiguous CA or UG sequence, the second nucleic acid fragment contains at least one contiguous CA or UG sequence complementary to the CA or UG sequence in the first nucleic acid fragment, the CA or UG sequence(s) of the first nucleic acid fragment and the CA or UG sequence(s) of the second nucleic acid fragment pair to form CA/UG and/or UG/CA site(s), modification can be made for at least one of the nucleotides in one CA/UG or UG/CA site, modification can also be made for at least one of the nucleotides in multiple CA/UG or UG/CA site(s), furthermore, modifications can also be made for multiple nucleotides in multiple CA/UG or UG/CA sites. Preferably, only one cytosine nucleotide is modified in each CA/UG or UG/CA site.

In the cases that the first nucleic acid fragment contains at least one contiguous UA sequence and at least one contiguous CA or UG sequence, the second nucleic acid fragment contains at least one contiguous UA sequence complementary to the UA sequence of the first nucleic acid fragment and one contiguous CA or UG sequence complementary to the CA or UG sequence of the first nucleic acid fragment, the UA sequence(s) of the first nucleic acid fragment and the UA sequence(s) of the second nucleic acid fragment pair to form UA/UA site(s), the CA or UG sequence(s) of the first nucleic acid fragment and the UG or CA sequence(s) of the second nucleic acid fragment pair to form CA/UG or UG/CA site(s), modification can be made for at least one of the nucleotides in UA/UA and CA/UG or UG/CA site; modification can also be made for at least one of the nucleotides in at least one of the UA/UA sites, at the same time, modification is also made for at least one of the nucleotides in at least one of the CA/UG or UG/CA sites.

In the present invention, the term "first nucleic acid fragment" refers to a nucleic acid fragment partly or completely homologous to the coding region of a target gene, the term "second nucleic acid fragment" refers to a nucleic acid fragment complementary to the coding region of a target gene. The term "complementary" refers to that two nucleotides can pair with each other in hybridization condition. For example, adenine (A) can pair with thymine (T) or uracil (U), cytosine (C) can pair with guanine (G).

In the present invention, said oligonucleotides can be small interfering RNA (siRNA) against a variety of target genes. For example, target genes can be an endogenous gene to be studied, a gene whose expression to be inhibited; for example, a gene associated with a disease or a disorder, such as oncogenes, viral genes, cell surface receptors, nuclear receptors, or genes implicated in cellular signaling pathway.

Based on the sequence of a target gene, specific siRNAs can be designed by person having ordinary skill in the art to which this invention belongs. For example, input target gene sequences or their NCBI Genbank sequence number into various siRNA design softwares, such as Insert Design Tool for the shRNA Vectors (Ambion), shRNA Explorer (Gene Link), siDirect (Yuki Naito et al. University of Tokyo), SiRNA at Whitehead (Whitehead Institute for Biomedical Research), BLOCK-iT RNAi Designer (invitrogen), RNAi Design (IDT), RNAi Explorer (Gene Link), siRNA Target Finder (Ambion), or siSearch (Stockholm Bioinformatics Center) etc., the software can design gene-specific siRNAs according to the requirements and siRNA design principles.

In addition, several siRNA design software can also perform genome-wide or transcriptome-wide homology search, so as to obtain target gene-specific or sequence-specific siRNAs. Said siRNA design software and principles are commonly understood by person having ordinary skill in the art to which this invention belongs. All these information are therefore included in the present invention as references.

In a preferred embodiment, the invention relates to a modified oligonucleotide, wherein all the nucleotides are unmodified nucleotides except the nucleotides in said CA/UG and/or UA/UA and/or UG/CA site(s). In these cases, incorporation of minimal chemical modifications into the modified oligonucleotide not only increase its stability, maintain its biological activity, further reduces potential cytocoxicity caused by extensive chemical modifications.

In the present invention, the modified oligonucleotide can be single-stranded or double-stranded oligonucleotide. In the cases of single-stranded oligonucleotide, said first nucleic acid fragment and second nucleic acid fragment can form double-stranded region by base-pairing of their complementary sequences. In the cases of double-stranded oligonucleotide, said modified oligonucleotide can contain a sense strand and antisense strand. The sense strand can be a contiguous fragment, or several discontiguous fragments; the antisense strand is a contiguous fragment.

In one aspect of the present invention, the invention relates to a modified oligonucleotide comprising a sense strand and an antisense chain. Said sense strand and antisense strand are contiguous nucleic acid fragments, said first nucleic acid fragment is in the sense strand, and said second nucleic acid fragment is in the antisense strand.

In another aspect of the present invention, the invention relates to a modified oligonucleotide comprising a sense strand and an antisense strand. Said sense strand comprises two or more discontiguous sense-strand fragments, said antisense strand is a contiguous nucleic acid fragment. Said first nucleic acid fragment is in the one or more sense-strand fragments, and the second nucleic acid fragment is in the antisense strand.

In the present invention, the term "sense strand" refers to a nucleic acid fragment partly or completely homologous to the coding region of a target gene, in the cases that the modified oligonucleotide is a double-stranded molecule. The term "second nucleic acid fragment" refers to a nucleic acid fragment complementary to the coding region of a target gene, in the cases that the modified oligonucleotide is a double-stranded molecule. In addition, in the cases that said modified oligonucleotide is a double-stranded molecule, said sense strand and antisense strand are contiguous nucleic acid fragments, the term "sense strand" and the term "first nucleic acid fragment" are used interchangeably, the term "antisense strand" and the "second nucleic acid fragment" are used interchangeably.

In the present invention, the term "sense-strand fragment" refers to the component fragments of the sense strand, in the cases that said sense strand comprises discontiguous fragments; the total length of all sense-strand fragments is equal to length of the sense strand. In addition, in the cases that said sense strand contains UA/UA site(s), the term "sense-strand fragment" and "first nucleic acid fragment" are used interchangeably.

In the present invention, said modified oligonucleotide can comprise only ribonucleotides, can also be a hybrid molecule comprising ribonucleotides and at least one deoxyribonucleotide.

In present invention, the term "potential toxicity" refers to the cellular toxicity effects caused by involved chemical modification(s) made on the modified nucleotide(s). In another word, it refers to the inhibition effects on cell growth, and thus named as "growth inhibition ratio" throughout this invention. The higher the growth inhibition ratio is, the greater the potential cytotoxicity is.

In the invention, said modifications are commonly understood by person having ordinary skill in the art to which this invention belongs. For example, the modification(s) are one or a combination of the following modifications:

(a) modifying the phosphodiester bond(s) connecting nucleotides in the oligonucleotide;

(b) modifying the sugar(s) of the nucleotide in the oligonucleotide;

(c) modifying the base(s) of the nucleotide in the oligonucleotide.

Said modification of phosphodiester bond is made by modifying the oxygen of the phosphodiester bond, including phosphorothioate modification and boranophosphate modification. As shown in the figures, these modifications replace the oxygen of the phosphodiester bond by sulfur or boron, respectively. Both modifications can stabilize the structure of siRNA, maintain high specificity and affinity of base pairing. However, boranophosphate siRNAs have stronger hydrophobicity and readily to form protein conjugate in the plasma, and less toxic to human body than phosphorothioate siRNAs.

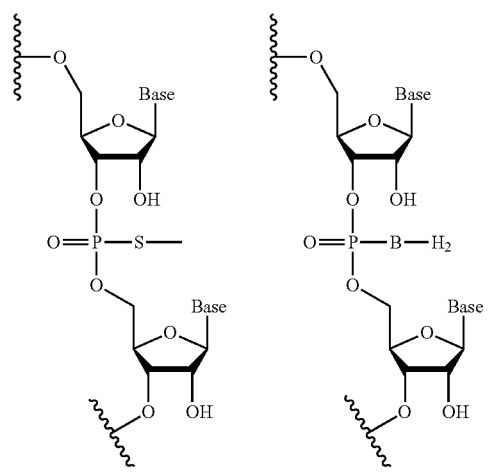

phosphorothioate modification    boranophosphate modification

Said modification of ribose refers to modifications of hydroxyl at 2'-position of the pentose sugars in siRNAs. Replacing the 2'-OH by methoxy or fluorine interfers with the interaction between the modified siRNA and serum ribonuclease, render the siRNA more stable in serum, and increase its resistance to nuclease degradation. Modifications of the 2'-hydroxyl of the pentose sugars comprises 2'-deoxy-2'-fluoro modification (2'-F), 2'-O-methyl modification (2'-OME), 2'-methoxyethyl-modification (2'-MOE), 2,4'-dinitrophenol-modification (2'-DNP), locked nucleic acid (LNA), 2'-amino modification (Amina modification), 2'-deoxy modification, etc.

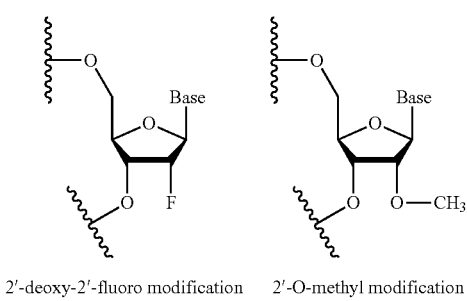

2'-deoxy-2'-fluoro modification    2'-O-methyl modification

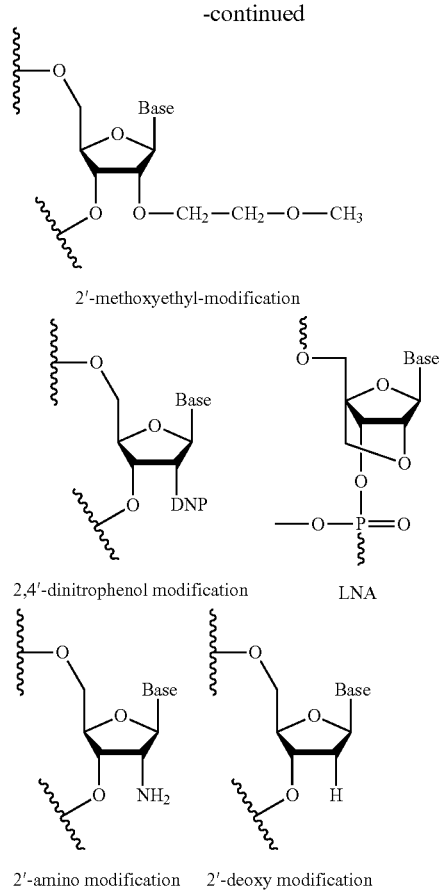

2'-methoxyethyl-modification 2,4'-dinitrophenol modification    LNA

2'-amino modification    2'-deoxy modification

Said base modification refers to modifications of the base of the nucleotide, including commonly used modifications such as 5'-bromo-uracil and 5'-iodo-uracil, and other modifications such as N3-methyl-uracil and 2,6-diaminopurine, and so on.

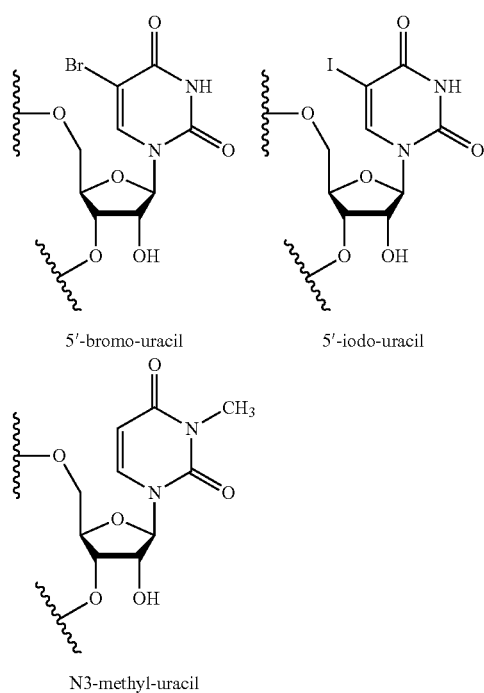

5'-bromo-uracil    5'-iodo-uracil

N3-methyl-uracil

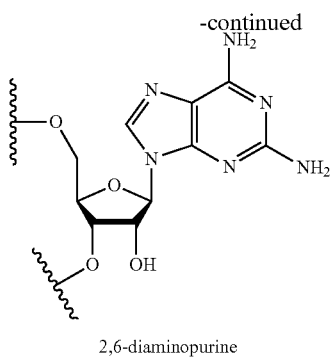

2,6-diaminopurine

Preferably, modified oligonucleotide provided in the present invention is a 2'-modified nucleotide. More preferably, the modified nucleotide is a 2'-OMe-modified or 2'-Fluoro-modified nucleotide. These modifications are made to increase the stability of the modified oligonucleotides in mammalian body fluids and enhance their resistance to nuclease degradation.

The present invention also relates to a method for preparing said modified oligonucleotide, comprising the steps of: selecting UA/UA and/or CA/UG site(s) from the oligonucleotide sequence to be prepared, synthesizing the oligonucleotide, wherein replacing nucleotide(s) in the selected site(s) by corresponding modified nucleotide(s). The resulting oligonucleotide comprises a first nucleic acid fragment and a second nucleic acid fragment, the first nucleic acid fragment and the second nucleic acid fragment form double-stranded region. (a) said first nucleic acid fragment contains at least one contiguous UA sequence, the second nucleic acid fragment contains at least one contiguous UA sequence complementary to the UA sequence in the first nucleic acid fragment, the UA sequence(s) of the first nucleic acid fragment and the complementary UA sequence(s) of the second nucleic acid fragment pair to form UA/UA site(s), wherein at least one of the nucleotides in said UA/UA site(s) is a modified nucleotide; more preferably, only one uracil nucleotide in each UA/UA site is a modified nucleotide.

(b) The first nucleic acid fragment contains at least one contiguous CA or UG sequence, the second nucleic acid fragment contains at least one contiguous CA or UG sequence complementary to the CA or UG sequence in the first nucleic acid fragment, the CA or UG sequence(s) of the first nucleic acid fragment and the CA or UG sequence(s) of the second nucleic acid fragment pair to form CA/UG and/or UG/CA site(s), wherein at least one of the nucleotides in said CA/UG and/or UG/CA site(s) is a modified nucleotide; more preferably, only cytosine nucleotide(s) in CA/UG or UG/CA site(s) is/are modified nucleotide(s).

(c) The first nucleic acid fragment contains at least one contiguous UA sequence and at least one contiguous CA or UG sequence, the second nucleic acid fragment contains at least one contiguous UA sequence complementary to the UA sequence of the first nucleic acid fragment and at least one contiguous CA or UG sequence complementary to the CA or UG sequence of the first nucleic acid fragment, the UA sequence(s) of the first nucleic acid fragment and the UA sequence(s) of the second nucleic acid fragment pair to form UA/UA site(s), the CA or UG sequence(s) of the first nucleic acid fragment and the UG or CA sequence(s) of the second nucleic acid fragment pair to form CA/UG or UG/CA site(s); wherein at least one of the nucleotides in said UA/UA and CA/UG and/or UG/CA site(s) is a modified nucleotide; or, at least one of the nucleotides in said UA/UA site is a modified nucleotide, and at the same time, at least one of the nucleotides in said CA/UG and/or UG/CA site(s) is a modified nucleotide.

In a preferred embodiment, the present invention relates to a modified oligonucleotide prepared by the claimed method in the invention, wherein all the nucleotides are unmodified nucleotides except the nucleotides in said UA/UA and/or CA/UG and/or UG/CA site(s).

In the invention, the structures of said oligonucleotides prepared by the provided method are commonly understood by person having ordinary skill in the art to which this invention belongs. Said structures can be any structure of existing nucleotide or oligonucleotide.

For example, the invention relates to a modified oligonucleotide that is prepared by the claimed method in the present invention can be a hairpin-structured and single-stranded nucleic acid molecule, the complementary nucleic acid sequences of the first nucleic acid fragment and the second nucleic acid fragment pair to form double-stranded region. In another aspect, the invention relates to a modified oligonucleotide that is prepared by the claimed method in the invention can contain a sense strand and an antisense strand, the sense strand and the antisense strand are contiguous nucleic acid fragments. Said first nucleic acid fragment is in the sense strand, said second nucleic acid fragment is in the antisense strand.

In yet another aspect, the invention relates to a modified oligonucleotide that is prepared by the claimed method in the present invention can contain a sense strand and an antisense strand. The sense strand contains two or more discontiguous sense-strand component fragments, the antisense strand is a contiguous nucleic acid fragment. Said first nucleic acid fragment is in one or more sense-strand component fragments, the second nucleic acid fragment is in the antisense strand.

In yet another aspect, the invention relates to a modified oligonucleotide that is prepared by the claimed method in the present invention can be a hybrid nucleic acid molecule comprising ribonucleotides and at least one deoxyribonucleotide.

In general, the oligonucleotides of the present invention can be synthesized using conventional protocols known in the art. Alternatively, synthesis can be performed by specialized biotechnology companies providing oligonucleotide synthesis service, such as Shanghai GenePharma Ltd, Guangzhou Ribo Biotechnology Ltd, or Invitrogen Ltd.

In general, the procedure of oligonucleotide synthesis comprises the steps of: (a) Synthesis of oligonucleotide; (b) Deprotection; (c) Purification; and (d) Desalination.

For example, detailed procedure of synthesizing a siRNA comprises the steps of:

(a) Synthesis of oligonucleotide. Single-stranded RNA oligonucleotide is produced by solid phase synthesis on a scale of 1 mmol, using an automatic DNA/RNA synthesizer (for example, Applied Biosystems EXPEDITE8909). Coupling time is set to 10-15 minutes for each synthesis cycle. From the starting material of 5'-O-dimethoxy-thymidine solid support, the first nucleotide is connected to the support in the first synthesis cycle; and for each following synthesis cycle, a new nucleotide is connected to the product of cycle n−1. Repeat the synthesis cycle until the completion of the synthesis of the oligonucleotide.

(b) Deprotection. Move siRNA-conjugated solid support into a test tube, and add 1 ml of ethanol/triethylamine (volume ratio of 1:3) in the test tube; seal the tube and place it in an incubator at 55 to 70° C., incubate for 2 to 30 hours; take out the siRNA-conjugated solid support and wash twice with double-distilled water (1 ml for each wash); collect the eluate and dry at room temperature for 30 minutes. Then, add 1 ml of 1M tetrabutylammonium fluoride in tetrahydrofuran solution, react at room temperature for 4 to 12 hours; add 2 ml ethanol and collect the sediment for obtaining the crude product of synthesized oligonucleotide.

(c) Purification. Dissolve the obtained crude oligonucleotide in 2 ml ammonium acetate solution (1 mole/ml), separate the oligonucleotide using C18 high pressure liquid chromatography for purified product oligonucleotide.

(d) Desalination. To further remove salt from the oligonucleotide, wash the purified oligonucleotide product 2 to 4 times by ethanol solution (2 ml per wash, 75% in weight ratio), and dry the oligonucleotide product at room temperature. Then, dissolve the sense strand and the antisense strand in 1 to 2 ml annealing buffer (10 mM Tris, pH 7.5-8.0, 50 mM NaCl), heat the solution to 95° C. and let it cool down slowly to room temperature, and keep the solution at room temperature for 16 to 22 hours for obtaining desalted siRNA solution.

The present invention also relates to a pharmaceutical composition for inhibiting the expression of a target gene in a mammal. Said pharmaceutical composition comprises at least one of the modified oligonucleotides disclosed in the invention, and at least one of pharmaceutically acceptable carriers. As used herein, "pharmaceutically acceptable carrier" should be compatible with the oligonucleotide(s) included in said pharmaceutical composition. In general, the "pharmaceutically acceptable carrier" can blend with the oligonucleotide(s) and do not significantly compromise the inhibition activity of the pharmaceutical composition on gene expression, under normal circumstances.

Examples of the substance of "pharmaceutically acceptable carrier" or components of the "pharmaceutically acceptable carrier" are sugars, such as lactose, glucose and sucrose; starch such as corn starch and potato starch; cellulose and its derivatives such as carboxymethyl fiber sodium, ethyl cellulose and methyl cellulose; West tragacanth powder; malt; gelatin; talc; solid lubricant such as stearic acid and magnesium stearate; calcium sulfate; vegetable oils such as peanut oil, cottonseed oil, sesame oil, olive oil, corn oil and cocoa butter; polyols such as propylene glycol, glycerol, sorbitol, mannose alcohol and polyethylene glycol; alginate; emulsifiers such as Tween; wetting agents, such as lauryl sulfate sodium; colorants; flavoring agent; pressure tablets, stabilizers; antioxidants; preservatives; pyrogen-free water; isotonic salt solution; and phosphate buffer, etc. Preferably, the carriers are selected from saline, glycerol and phosphate phosphate buffer saline.

The pharmaceutical composition provided by the invention can be made in a variety of medically acceptable formulations, and administered by physicians in an optimal dosage according to patient's type, age, weight, disease condition, delivery approach and other factors. The formulations provided by the present invention includes a variety of liquid formulations such as oral, injection, sublingual agent, tablet formulations prepared by adding suitable excipient, capsule formulation, or a variety of other formulations, etc. Preferred formulations of said pharmaceutical composition comprise injection, capsules, sublingual, oral liquid, aerosol, or patch.

In another aspect, the invention also provides a method for preparing the pharmaceutical composition, said method comprises formulating the modified oligonucleotides and pharmaceutically acceptable carriers to obtain the said pharmaceutical compositions. No particular order or rules need to be applied to the mixing of the modified oligonucleotides and the pharmaceutically acceptable carriers.

In another aspect, the invention also relates to a method for inhibiting the expression of a target gene in a cell, compreseing:
(a) introducing the modified oligonucleotide(s) into at least one of the cells; and
(b) incubating the cells for a time sufficient to obtain inhibition of the expression of the target gene in the cell.

Preferably, the cells are mammalian cells.

The present invention also relates to a method for preparing an oligonucleotide that is highly stable in a biological sample and can inhibit the expression of a target gene, comprising the steps of:
(a) selecting one or more nucleic acid sequences of 18 to 30 nucleotides in length from the nucleotide sequence of the mRNA resulting from the transcription of the target gene; and
(b) synthesizing the selected sequences, wherein one strand comprises a sequence complementary to selected sequence in (a); and
(c) testing one or more oligonucleotides of (b) for their activity to inhibit the expression of the target gene in a biological sample; and
(d) selecting one or more oligonucleotides of (c) possessing the activity to inhibit the expression of the target gene in a biological sample; and
(e) in the oligonucleotides selected in (d), identifying in the nucleotide sequences of all occurrences of the UA/UA, CA/UG and UG/CA site(s); and
(f) synthesizing one or more oligonucleotides selected in (d), wherein at least one nucleotide in the UA/UA, CA/UG and UG/CA site(s) identified in (e) is replaced by its corresponding modified nucleotide.

Preferably, only cytidine nucleotide(s) in all occurrences of the CA/UG or UG/CA site is/are modified, only one uracil nucleotide in each UA/UA site is modified; more preferably, all the nucleotides are unmodified nucleotides except the nucleotides in said CA/UG and/or UA/UA and/or UG/CA site(s).

A method of treating a disease caused by expression of a target gene in a subject is provided in the present invention. Said method comprises administering to said subject a pharmaceutical composition comprising at least one of said oligonucleotides and a pharmaceutically acceptable carrier. Preferably, the subject is mammalian; more preferably, the subject is human being.

The present invention also relates to a method for preparing an oligonucleotide with nuclease resistance, said method comprises the steps of:
(a) identifying in the nucleotide sequence of the oligonucleotide all occurrences of UA/UA, CA/UG and UG/CA site(s); and
(b) synthesizing the oligonucleotide, wherein replaces nucleotide(s) in the UA/UA, CA/UG and UG/CA site(s) identified in (a) by corresponding modified nucleotide(s). Preferably, only cytidine nucleotide(s) in all occurrences of the CA/UG or UG/CA site(s) identified in (a) is/are modified, only one uracil nucleotide in each UA/UA site identified in (a) is modified. More preferably, all the nucleotides are unmodified nucleotides except the nucleotides in said CA/UG and/or UA/UA and/or UG/CA site(s).

The invention also relates to a method to identify an oligonucleotide with stability in biological samples, comprising the steps of:
(a) providing a first modified oligonucleotide, and a second oligonucleotide identical in sequence to the first oligonucleotide except that it dose not have modified nucleotide(s); and
(b) determining the stability and the degradation process of said first and second oligonucleotide in the biological sample by contacting the two oligonucleotides with the biological sample under identical conditions,
Whereby, where the first modified oligonucleotide is degraded less rapidly than the second oligonucleotide, the oligonucleotide with stability in a biological sample is identified.

By specifically modifying the UA/UA and/or CA/UG and/or UG/CA site(s) identified in an oligonucleotid, the invention achieves stabilizing the modified oligonucleotide by introducing only a relatively small amount chemically modified nucleotides into the oligonucleotide. Compared to randomly modified oligonucleotide in the art, the specific modification approach disclosed in the present invention greatly reduces the potential cytotoxicity and influence on the biological activity of the modified oligonucleotide.

Inventors of the present invention performed comprehensive investigation on the in vivo degradation of synthetic oligonucleotide, and found that replacing a relatively small amount of the nucleotides in UA/UA and/or CA/UG site(s) identified in a oligonucleotide sequence by corresponding chemically modified nucleotide(s) can greatly increase the stability of the modified oligonucleotide in biological samples, and at the same time, reduces the cytotoxicity caused by extensive and random modifications usually performed in the art, as well as the effects on biological activity.

The present invention is further illustrated using the following embodiments. Should be understood that the materials, methods, and examples described in the present invention are illustrative only and not intented to be limiting. Unless otherwise defined, all reagents and culture medium used in the invention are commercially available.

EXAMPLE 1

Synthesis of siRNA Oligonucleotides siRNA oligonucleotides against target genes in table 1-182 were synthesized by Genepharma Ltd (Shanghai, China).

EXAMPLE 2

Assays of Serum Stability, Silencing Efficacy and Cytotoxicity of Variously Modified siRNA Serum stability, silencing efficacy and cytotoxicity assay of modified and unmodified siRNAs in table 1-182 were tested using the methods of:

1. Serum Stability Assay

Serum degradation assays were performed at 37° C. by incubating 4 µL 20 µM modified or unmodified siRNA in 32 µL 1×PBS solution, containing 4 µL fetal bovine serum (Sigma). The final serum concentration was 10%. After serum treatment of 0, 3 or 6 hours, 10 µL reaction solution was removed and frozen immediately in liquid nitrogen to terminate the reaction. The samples were then stored at −80° C. until analysis.

Prepare a 20% polyacrylamide gel; mix 3 uL 3× loading buffer (30 mM EDTA, 36% glycerol, 0.06% bromophenol blue) with serum-treated siRNA sample; then load the sample into the gel and run electrophoresis at 80 mA under constant current condition. After electrophoresis, add 1× Sybr Gold (Invitrogen, Cat. 11494) into the sample and let it stain for 10 minutes before imaging and analysis. The results were presented in Table 1-182.

2. Silencing Efficacy Assay

Human embryonic kidney cells (HEK293) were grown in Dulbecco's modified Eagle's medium supplemented with 10% fetal bovine serum, 2 mM L-glutamine, 100 units/ml penicillin and 100 µg/ml streptomycin (Life Technologies, Gibco), and seeded into 24-well plates at a density of $1\times10^5$ cells (0.5 mL culture medium/well). After 24 hours incubation and the cell density reached 50% confluence, the culture medium was changed to Opti-MEM (Gibco). Lipofectamine™ 2000 transfection reagent (Invitrogen) was used to co-transfect siRNA and reporter plasmids. Report vector (0.17 µg/well) carrying the target site of tested siRNA and firefly luciferase gene was transfected into the cells together with pRL-TK control vector carrying renilla luciferase gene. The final concentration of siRNA was 13 nM. Each siRNA was parallely transfected in three wells, with the same amount of the two reporter plasmids. The three wells without siRNA treatment were used as control. Four hours after transfection, the culture medium was changed to one milliliter DMEM growth medium (10% fetal bovine serum, 2 mM L-glutamine, 100 units/ml penicillin and 100 µg/ml streptomycin). Twenty-four later, the cells were lysated by adding 10 uL cell lysis buffer, and the activity of both luciferases was measured with a fluorometer (Synergy HT, BioTek, USA), using Dual-Luciferase reporter assay system (Promega) according to the manufacturer's instructions. Silencing efficacy of the siRNA was calculated by the following formula, using siRNA-untreated cells as control. All the experiments were performed in triplicate and repeated for at least twice. The results were shown in table 1-182.

Silencing efficacy=(the expressional amount of firefly luciferase in test group/the expressional amount of renilla luciferase in test group)/(the expressional amount of firefly luciferase in control group/the expressional amount of renilla luciferase in control group)

3. Cytotoxicity Assay of Modified siRNA

Human embryonic kidney cells (HEK293) were grown in Dulbecco's modified Eagle's medium supplemented with 10% fetal bovine serum, 2 mM L-glutamine, 100 units/ml penicillin and 100 µg/ml streptomycin (Life Technologies, Gibco), and seeded into 24-well plates at a density of $1\times10^5$ cells (0.5 mL culture medium/well). After 24 hours incubation and the cell density reached 50% confluence, the culture medium was changed to Opti-MEM (Gibco). Lipofectamine™ 2000 transfection reagent (Invitrogen) was used to transfect chemically synthetic siRNA into the cells at a final concentration of 13 nM. Each siRNA was parallely transfected in three independent wells, with three other siRNA-untreated wells as control. Four hours after transfection, the culture medium was changed to one milliliter DMEM growth medium (10% fetal bovine serum, 2 mM L-glutamine, 100 units/ml penicillin and 100 µg/ml streptomycin).

Twenty-four later, removed the culture medium and washed the cells once with PBS. Add 1 mL PBS and 10 µL MTT into each well, incubate in a 5% $CO_2$ incubator at 37° C. for 4-6 hours; add 0.1 mL acidified isopropanol into each well, mix by vortexing; measure the absorbance value (A value) at 570 nm for each well, using a microplate reader. The growth inhibition ratio was calculated using the following formula, the results were shown in table 1-182.

Growth inhibition ratio (%)=(A value of test group−A value of control group)/A value of control group×100%

TABLE 1

| Gene | Human KAZRIN(NM_201628)<br>(SEQ ID NO: 1)<br>siRNA | Locus Stability | 718-738 BP | |
|---|---|---|---|---|
| | | | Expression inhibition ratio | Growth inhibition ratio |
| 1-1 | Unmodified siRNA<br>5-AGCGCUUAAAGGGCGAGAAGAUU<br>(SEQ ID NO: 2)<br>UUUCGCGAAUUUCCCGCUCUUCU-5<br>(SEQ ID NO: 3) | + | 84% | 0% |
| 1-2A | Random modification (2'-deoxy-2'-fluoro)<br>5-AGCGCUUAAAGGGCGAGAAGAUU<br>(SEQ ID NO: 4)<br>UUUCGCGAAUUUCCCGCUCUUCU-5<br>(SEQ ID NO: 3) | ++ | 27% | 37% |
| 1-2B | Random modification (2'-O-methyl)<br>5-AGCGCUUAAAGGGCGAGAAGAUU<br>(SEQ ID NO: 2)<br>UUUCGCGAAUUUCCCGCUCUUCU-5<br>(SEQ ID NO: 5) | ++ | 0% | 32% |
| 1-3A | Specific modification (2'-O-methyl)<br>5-AGCGCUUAAAGGGCGAGAAGAUU<br>(SEQ ID NO: 6)<br>UUUCGCGAAUUUCCCGCUCUUCU-5<br>(SEQ ID NO: 7) | ++ | 27% | 15% |
| 1-3B | Specific modification (2'-deoxy-2'fluoro)<br>5-AGCGCUUAAAGGGCGAGAAGAUU<br>(SEQ ID NO: 8)<br>UUUCGCGAAUUUCCCGCUCUUCU-5<br>(SEQ ID NO: 7) | +++ | 44% | 12% |
| 1-3C | Specific modification (2'-O-methyl)<br>5-AGCGCUUAAAGGGCGAGAAGAUU<br>(SEQ ID NO: 6)<br>UUUCGCGAAUUUCCCGCUCUUCU-5<br>(SEQ ID NO: 9) | ++ | 56% | 10% |
| 1-3D | Specific modification (2'-O-methyl)<br>5-AGCGCUUAAAGGGCGAGAAGAUU<br>(SEQ ID NO: 8)<br>UUUCGCGAAUUUCCCGCUCUUCU-5<br>(SEQ ID NO: 9) | ++ | 81% | 11% |
| 1-3E | Specific modification (2'-O-methyl)<br>5-AGCGCUUAAAGGGCGAGAAGAUU<br>(SEQ ID NO: 8)<br>UUUCGCGAAUUUCCCGCUCUUCU-5<br>(SEQ ID NO: 10) | +++ | 49% | 10% |
| 1-3F | Specific modification (2'-deoxy-2'-fluoro)<br>5-AGCGCUUAAAGGGCGAGAAGAUU<br>(SEQ ID NO: 2)<br>UUUCGCGAAUUUCCCGCUCUUCU-5<br>(SEQ ID NO: 7) | ++ | 49% | 14% |
| 1-3G | Specific modification (2'-deoxy-2'-fluoro)<br>5-AGCGCUUAAAGGGCGAGAAGAUU<br>(SEQ ID NO: 8)<br>UUUCGCGAAUUUCCCGCUCUUCU-5<br>(SEQ ID NO: 3) | ++ | 85% | 0% |
| 1-3H | Specific modification (2'-O-methyl)<br>5-AGCGCUUAAAGGGCGAGAAGAUU<br>(SEQ ID NO: 2)<br>UUUCGCGAAUUUCCCGCUCUUCU-5<br>(SEQ ID NO: 9) | ++ | 84% | 6% |
| 1-3I | Specific modification (2'-O-methyl)<br>5-AGCGCUUAAAGGGCGAGAAGAUU<br>(SEQ ID NO: 6)<br>UUUCGCGAAUUUCCCGCUCUUCU-5<br>(SEQ ID NO: 10) | ++ | 23% | 10% |

TABLE 1-continued

| | Human KAZRIN(NM_201628) (SEQ ID NO: 1) | | 718-738 BP | |
|---|---|---|---|---|
| Gene | siRNA | Locus Stability | Expression inhibition ratio | Growth inhibition ratio |
| 1-3J | Specific modification (2'-O-methyl)<br>5-AGCGCUUAAAGGGCGAGAAGAUU<br>(SEQ ID NO: 11)<br>UUUCGCGAAAUUUCCCGCUCUUCU-5<br>(SEQ ID NO: 7) | ++ | 41% | 14% |
| 1-3K | Specific modification (2'-deoxy-2'-fluoro)<br>5-AGCGCUUAAAGGGCGAGAAGAUU<br>(SEQ ID NO: 11)<br>UUUCGCGAAAUUUCCCGCUCUUCU-5<br>(SEQ ID NO: 10) | ++ | 47% | 15% |
| 1-3L | Specific modification (2'-O-methyl)<br>5-AGCGCUUAAAGGGCGAGAAGAUU<br>(SEQ ID NO: 11)<br>UUUCGCGAAAUUUCCCGCUCUUCU-5<br>(SEQ ID NO: 9) | ++ | 83% | 12% |
| 1-3M | Specific modification (2'-O-methyl)<br>5-AGCGCUUAAAGGGCGAGAAGAUU<br>(SEQ ID NO: 6)<br>UUUCGCGAAAUUUCCCGCUCUUCU-5<br>(SEQ ID NO: 3) | ++ | 59% | 7% |
| 1-3N | Specific modification (2'-deoxy-2'-fluoro)<br>5-AGCGCUUAAAGGGCGAGAAGAUU<br>(SEQ ID NO: 2)<br>UUUCGCGAAAUUUCCCGCUCUUCU-5<br>(SEQ ID NO: 10) | ++ | 49% | 0% |
| 1-3O | Specific modification (2'-O-methyl)<br>5-AGCGCUUAAAGGGCGAGAAGAUU<br>(SEQ ID NO: 11)<br>UUUCGCGAAAUUUCCCGCUCUUCU-5<br>(SEQ ID NO: 3) | ++ | 85% | 5% |
| 1-3P | Unmodified siRNA(hairpin, unmodified)<br>5-AGCGCUUAAAGGGCGAGAAGAUUN<br>(SEQ ID NO: 1349)<br>UUUCGCGAAUUUCCCGCUCUUCUNNN<br>(SEQ ID NO: 1350) | +++ | 85% | 0% |
| 1-3Q | Specific modification (hairpin, 2'-O-methyl)<br>(SEQ ID NO: 13)<br>5-AGCGCUUAAAGGGCGAGAAGAUUN<br>(SEQ ID NO: 1349)<br>UUUCGCGAAUUUCCCGCUCUUCUNNN<br>(SEQ ID NO: 1350) | +++ | 53% | 10% |
| 1-3R | Specific modification (discontiguous sense strand, 2'-deoxy-2'-fluoro)<br>5-AGCGCUUAAAGG\|GCGAGAAGAUU<br>(SEQ ID NO: 14, 15)<br>UUUCGCGAAAUUUCCCGCUCUUCU-5<br>(SEQ ID NO: 3) | +++ | 78% | 2% |
| 1-3S | Specific modification (hybrid molecule, 2'-O-methyl)<br>5-AGCGCUUAAAGGGCG(DA)GAAGAUU<br>(SEQ ID NO: 16)<br>UUUCGCGAAAUUUCCCGCUCUUCU-5<br>(SEQ ID NO: 10) | ++ | 50% | 7% |
| 1-3T | Specific modification (hybrid molecule, 2'-deoxy-2'-fluoro)<br>5-AGCGCUUAAAGGGCG(DA)GAAGAUU<br>(SEQ ID NO: 17)<br>UUUCGCGAAAUUUCCCGCUCUUCU-5<br>(SEQ ID NO: 9) | ++ | 79% | 9% |
| 1-3U | Specific modification (phosphodiester bond modification)<br>5-AGCGCUUAAAGGG-CGAGAAGAUU<br>(SEQ ID NO: 18)<br>UUUCGCGAAAUUUCCCGCUCUUCU-5<br>(SEQ ID NO: 10) | +++ | 45% | 11% |

TABLE 1-continued

| | Human KAZRIN(NM_201628) | | 718-738 BP | |
|---|---|---|---|---|
| Gene | (SEQ ID NO: 1) siRNA | Locus Stability | Expression inhibition ratio | Growth inhibition ratio |
| 1-3V | Specific modification (2'-deoxy-2'-fluoro)<br>5-AGCGCUUAAAGGGCGAGAAGAUU<br>(SEQ ID NO: 8)<br>UUUCGCGAAUUUCCCGCUCUUCU-5<br>(SEQ ID NO: 10) | +++ | 51% | 8% |

TABLE 2

| | Mouse(NM_008960.2) | | 1148-1166 BP | |
|---|---|---|---|---|
| Gene | (SEQ ID NO: 19) SIRNA | Locus Stability | Expression inhibition ratio | Growth inhibition ratio |
| 2-1 | Unmodified siRNA<br>5-AACCCACCACAGCUAGAACUU<br>(SEQ ID NO: 20)<br>UUGGGUGGUGUCGAUCUUGAA-5<br>(SEQ ID NO: 21) | + | 86% | 0% |
| 2-2A | Random modification (2'-O-methyl)<br>5-AACCCACCACAGCUAGAACUU<br>(SEQ ID NO: 20)<br>UUGGGUGGUGUCGAUCUUGAA-5<br>(SEQ ID NO: 22) | ++ | 15% | 34% |
| 2-2B | Random modification (2'-deoxy-2'-fluoro)<br>5-AACCCACCACAGCUAGAACUU<br>(SEQ ID NO: 23)<br>UUGGGUGGUGUCGAUCUUGAA-5<br>(SEQ ID NO: 21) | ++ | 37% | 38% |
| 2-3A | Specific modification (2'-deoxy-2'-fluoro)<br>5-AACCCACCACAGCUAGAACUU<br>(SEQ ID NO: 24)<br>UUGGGUGGUGUCGAUCUUGAA-5<br>(SEQ ID NO: 25) | ++ | 57% | 17% |
| 2-3B | Specific modification (2'-O-methyl)<br>5-AACCCACCACAGCUAGAACUU<br>(SEQ ID NO: 26)<br>UUGGGUGGUGUCGAUCUUGAA-5<br>(SEQ ID NO: 27) | +++ | 24% | 34% |
| 2-3C | Specific modification (2'-O-methyl)<br>5-AACCCACCACAGCUAGAACUU<br>(SEQ ID NO: 26)<br>UUGGGUGGUGUCGAUCUUGAA-5<br>(SEQ ID NO: 25) | +++ | 51% | 17% |
| 2-3D | Specific modification (2'-O-methyl)<br>5-AACCCACCACAGCUAGAACUU<br>(SEQ ID NO: 28)<br>UUGGGUGGUGUCGAUCUUGAA-5<br>(SEQ ID NO: 25) | ++ | 44% | 37% |
| 2-3E | Specific modification (2'-O-methyl)<br>5-AACCCACCACAGCUAGAACUU<br>(SEQ ID NO: 23)<br>UUGGGUGGUGUCGAUCUUGAA-5<br>(SEQ ID NO: 29) | +++ | 7% | 52% |
| 2-3F | Specific modification (2'-O-methyl)<br>5-AACCCACCACAGCUAGAACUU<br>(SEQ ID NO: 30)<br>UUGGGUGGUGUCGAUCUUGAA-5<br>(SEQ ID NO: 31) | ++ | 81% | 14% |
| 2-3G | Specific modification (2'-O-methyl)<br>5-AACCCACCACAGCUAGAACUU<br>(SEQ ID NO: 32)<br>UUGGGUGGUGUCGAUCUUGAA-5<br>(SEQ ID NO: 31) | +++ | 32% | 35% |

TABLE 2-continued

| Mouse(NM_008960.2) (SEQ ID NO: 19) Gene SIRNA | Locus Stability | 1148-1166 BP Expression inhibition ratio | Growth inhibition ratio |
|---|---|---|---|
| 2-3H Specific modification (2'-O-methyl)<br>5-AACCCACCACAGCUAGAACUU<br>(SEQ ID NO: 24)<br>UUGGGUGGUGUCGAUCUUGAA-5<br>(SEQ ID NO: 21) | ++ | 79% | 6% |
| 2-3I Specific modification (2'-O-methyl)<br>5-AACCCACCACAGCUAGAACUU<br>(SEQ ID NO: 23)<br>UUGGGUGGUGUCGAUCUUGAA-5<br>(SEQ ID NO: 21) | ++ | 51% | 42% |
| 2-3J Specific modification (2'-deoxy-2'-fluoro)<br>5-AACCCACCACAGGCUAGAACUU<br>(SEQ ID NO: 33)<br>UUGGGUGGUGUCGAUCUUGAA-5<br>(SEQ ID NO: 21) | ++ | 75% | 16% |
| 2-3K Specific modification (2'-O-methyl)<br>5-AACCCACCACAGCUAGAACUU<br>(SEQ ID NO: 34)<br>UUGGGUGGUGUCGAUCUUGAA-5<br>(SEQ ID NO: 21) | ++ | 84% | 4% |
| 2-3L Specific modification (2'-O-methyl)<br>5-AACCCACCACAGCUAGAACUU<br>(SEQ ID NO: 30)<br>UUGGGUGGUGUCGAUCUUGAA-5<br>(SEQ ID NO: 21) | ++ | 81% | 3% |
| 2-3M Specific modification (2'-deoxy-2'-fluoro)<br>5-AACCCACCACAGCUAGAACUU<br>(SEQ ID NO: 23)<br>UUGGGUGGUGUCGAUCUUGAA-5<br>(SEQ ID NO: 21) | +++ | 54% | 33% |
| 2-3N Specific modification (2'-O-methyl)<br>5-AACCCACCACAGCUAGAACUUNN<br>(SEQ ID NO: 35)<br>UUGGGUGGUGUCGAUCUUGAANN<br>(SEQ ID NO: 36) | +++ | 82% | 5% |
| 2-3O Specific modification (2'-deoxy-2'-fluoro)<br>5-AACCCACCACAGCUAGAACUU<br>(SEQ ID NO: 20)<br>UUGGGUGGUGUCGAUCUUGAA-5<br>(SEQ ID NO: 37) | ++ | 14% | 23% |
| 2-3P Unmodified siRNA (hairpin, unmodified)<br>(SEQ ID NO: 38)<br>5-AACCCACCACAGCUAGAACUUNN<br>(SEQ ID NO: 35)<br>UUGGGUGGUGUCGAUCUUGAANN<br>(SEQ ID NO: 36) | +++ | 78% | 5% |
| 2-3Q Specific modification (hairpin, 2'-O-methyl)<br>5-AACCCACCACAGCUAGAACUU<br>(SEQ ID NO: 39)<br>UUGGGUGGUGUCGAUCUUGAA-5<br>(SEQ ID NO: 21) | +++ | 42% | 34% |

TABLE 3

| Human BIC(NR_001458.3) (SEQ ID NO: 40) gene SIRNA | Locus Stability | 289-310 BP Expression inhibition ratio | Growth inhibition ratio |
|---|---|---|---|
| 3-1 Unmodified siRNA<br>5-UUAAUGCUAAUCGUGAUAGGGGUU<br>(SEQ ID NO: 41)<br>AUAAUUACGAUUAGCACUAUCCCC-5<br>(SEQ ID NO: 42) | + | 88% | 0% |

TABLE 3-continued

| Human BIC(NR_001458.3) (SEQ ID NO: 40) gene SIRNA | Locus Stability | 289-310 BP Expression inhibition ratio | Growth inhibition ratio |
|---|---|---|---|
| 3-2A Random modification (2'-O-methyl)<br>5-UUAAUGCUAAUCGUGAUAGGGGUU<br>(SEQ ID NO: 43)<br>AUAAUUACGAUUAGCACUAUCCCC-5<br>(SEQ ID NO: 42) | ++ | 49% | 41% |
| 3-2B Random modification (2'-deoxy-2'-fluoro)<br>5-UUAAUGCUAAUCGUGAUAGGGGUU<br>(SEQ ID NO: 41)<br>AUAAUUACGAUUAGCACUAUCCCC-5<br>(SEQ ID NO: 44) | ++ | 15% | 37% |
| 3-3A Specific modification (2'-O-methyl)<br>5-UUAAUGCUAAUCGUGAUAGGGGUU<br>(SEQ ID NO: 45)<br>AUAAUUACGAUUAGCACUAUCCCC-5<br>(SEQ ID NO: 46) | +++ | 80% | 11% |
| 3-3B Specific modification (2'-O-methyl)<br>5-UUAAUGCUAAUCGUGAUAGGGGGUU<br>(SEQ ID NO: 47)<br>AUAAUUACGAUUAGCACUAUCCCC-5<br>(SEQ ID NO: 46) | +++ | 51% | 31% |
| 3-3C Specific modification (2'-deoxy-2'-fluoro)<br>5-UUAAUGCUAAUCGUGAUAGGGGUU<br>(SEQ ID NO: 48)<br>AUAAUUACGAUUAGCACUAUCCCC-5<br>(SEQ ID NO: 46) | +++ | 45% | 57% |
| 3-3D Specific modification (2'-deoxy-2'-fluoro)<br>5-UUAAUGCUAAUCGUGAUAGGGGUU<br>(SEQ ID NO: 49)<br>AUAAUUACGAUUAGCACUAUCCCC-5<br>(SEQ ID NO: 46) | ++ | 65% | 32% |
| 3-3E Specific modification (2'-O-methyl)<br>5-UUAAUGCUAAUCGUGAUAGGGGUU<br>(SEQ ID NO: 50)<br>AUAAUUACGAUUAGCACUAUCCCC-5<br>(SEQ ID NO: 46) | ++ | 75% | 27% |
| 3-3F Specific modification (2'-O-methyl)<br>5-UUAAUGCUAAUCGUGAUAGGGGUU<br>(SEQ ID NO: 43)<br>AUAAUUACGAUUAGCACUAUCCCC-5<br>(SEQ ID NO: 46) | ++ | 49% | 48% |
| 3-3G Specific modification (2'-O-methyl)<br>5-UUAAUGCUAAUCGUGAUAGGGGUU<br>(SEQ ID NO: 1351)<br>AUAAUUACGAUUAGCACUAUCCCC-5<br>(SEQ ID NO: 51) | ++ | 23% | 52% |
| 3-3H Specific modification (2'-O-methyl)<br>5-UUAAUGCUAAUCGUGAUAGGGGUU<br>(SEQ ID NO: 52)<br>AUAAUUACGAUUAGCACUAUCCCC-5<br>(SEQ ID NO: 46) | ++ | 17% | 42% |
| 3-3I Specific modification (2'-deoxy-2'-fluoro)<br>5-UUAAUGCUAAUCGUGAUAGGGGUU<br>(SEQ ID NO: 50)<br>AUAAUUACGAUUAGCACUAUCCCC-5<br>(SEQ ID NO: 53) | ++ | 65% | 21% |
| 3-3J Specific modification (2'-O-methyl)<br>5-UUAAUGCUAAUCGUGAUAGGGGUU<br>(SEQ ID NO: 1351)<br>AUAAUUACGAUUAGCACUAUCCCC-5<br>(SEQ ID NO: 54) | ++ | 17% | 51% |

TABLE 3-continued

| gene | Human BIC(NR_001458.3) (SEQ ID NO: 40) SIRNA | Locus Stability | 289-310 BP Expression inhibition ratio | Growth inhibition ratio |
|---|---|---|---|---|
| 3-3K | Specific modification (2'-O-methyl)<br>5-UUAAUGCUAAUCGUGAUAGGGGUU<br>(SEQ ID NO: 1351)<br>AUAAUUACGAUUAGCACUAUCCCC-5<br>(SEQ ID NO: 53) | ++ | 35% | 48% |
| 3-3L | Specific modification (2'-deoxy-2'-fluoro)<br>5-UUAAUGCUAAUCGUGAUAGGGGUU<br>(SEQ ID NO: 43)<br>AUAAUUACGAUUAGCACUAUCCCC-5<br>(SEQ ID NO: 53) | ++ | 53% | 45% |
| 3-3M | Specific modification (2'-deoxy-2'-fluoro)<br>5-UUAAUGCUAAUCGUGAUAGGGGUU<br>(SEQ ID NO: 50)<br>AUAAUUACGAUUAGCACUAUCCCC-5<br>(SEQ ID NO: 55) | ++ | 28% | 39% |
| 3-3N | Specific modification (2'-O-methyl)<br>5-UUAAUGCUAAUCGUGAUAGGGGUU<br>(SEQ ID NO: 50)<br>AUAAUUACGAUUAGCACUAUCCCC-5<br>(SEQ ID NO: 44) | +++ | 8% | 49% |
| 3-3O | Specific modification (2'-O-methyl)<br>5-UUAAUGCUAAUCGUGA(DT)AGGGGUU<br>(SEQ ID NO: 56)<br>AUAAUUACGAUUAGCACUAUCCCC-5<br>(SEQ ID NO: 46) | ++ | 70% | 9% |
| 3-3P | Specific modification (2'-O-methyl)<br>5-UUAAUGCUAAUCGUGAAGG(DG)GUU<br>(SEQ ID NO: 57)<br>AUAAUUACGAUUAGCACUAUCCCC-5<br>(SEQ ID NO: 46) | ++ | 72% | 12% |

TABLE 4

| gene | Human BIC(NR_001458.3) (SEQ ID NO: 40) SIRNA | Locus Stability | 745-763 BP Expression inhibition ratio | Growth inhibition ratio |
|---|---|---|---|---|
| 4-1 | unmodified<br>5-AGAAGGACUACUAACCUCCTT<br>(SEQ ID NO: 58)<br>TTCUUCCUGAUGAUUGGAGG-5<br>(SEQ ID NO: 59) | ++ | 83% | 0% |
| 4-2 | Random modification (2'-O-methyl)<br>5-AGAAGGACUACUAACCUCCTT<br>(SEQ ID NO: 60)<br>TTUCUCCUGAUGAUUGGAGG-5<br>(SEQ ID NO: 61) | ++ | 49% | 41% |
| 4-3A | Specific modification (2'-O-methyl)<br>5-AGAAGGACUACUAACCUCCTT<br>(SEQ ID NO: 62)<br>TTCUUCCUGAUGAUUGGAGG-5<br>(SEQ ID NO: 59) | ++ | 80% | 15% |
| 4-3B | Specific modification (2'-O-methyl)<br>5-AGAAGGACUACUAACCUCCTT<br>(SEQ ID NO: 63)<br>TTCUUCCUGAUGAUUGGAGG-5<br>(SEQ ID NO: 64) | +++ | 81% | 5% |

TABLE 5

| gene | Human BIC(NR_001458.3) (SEQ ID NO: 40) SIRNA | Locus Stability | 749-767 BP Expression inhibition ratio | Growth inhibition ratio |
|---|---|---|---|---|
| 5-1 | Unmodified siRNA<br>5-GGACUACUAACCUCCAGUUTT<br>(SEQ ID NO: 65)<br>TTCCUGAUGAUUGGAGGUCAA-5<br>(SEQ ID NO: 66) | + | 69% | 0% |
| 5-2 | Random modification (2'-O-methyl)<br>5-GGACUACUAACCUCCAGUTT<br>(SEQ ID NO: 67)<br>TTCCUGAUGAUUGGAGGUCAA-5<br>(SEQ ID NO: 68) | ++ | 7% | 53% |
| 5-3A | Specific modification (2'-O-methyl)<br>5-GGACUACUAACCUCCAGUTT<br>(SEQ ID NO: 69)<br>TTCCUGAUGAUUGGAGGUCAA-5<br>(SEQ ID NO: 66) | ++ | 65% | 21% |
| 5-3B | Specific modification (2'-O-methyl)<br>5-GGA<u>CUACU</u>AACCUC<u>C</u>AGUUTT<br>(SEQ ID NO: 70)<br>TTCCUGA<u>UGAU</u>UGGAGGU<u>C</u>AA-5<br>(SEQ ID NO: 71) | +++ | 69% | 9% |

TABLE 6

| gene | Human BIC(NR_001458.3) (SEQ ID NO: 40) SIRNA | Locus Stability | 807-825 BP Expression inhibition ratio | Growth inhibition ratio |
|---|---|---|---|---|
| 6-1 | Unmodified siRNA<br>5-GAAACUGGUACUUUCCCCCTT<br>(SEQ ID NO: 72)<br>TTCUUUGACCAUGAAAGGGGG-5<br>(SEQ ID NO: 73) | + | 69% | 0% |
| 6-2 | Random modification (2'-deoxy-2'-fluoro)<br>5-GAAACUGGUACUUUCCCCCTT<br>(SEQ ID NO: 74)<br>TTCUUUGACCAUGAAAGGGGG-5<br>(SEQ ID NO: 73) | ++ | 60% | 37% |
| 6-3A | Specific modification (2'-deoxy-2'-fluoro)<br>5-GAAACUGG<u>UA</u>CUUUCCCCCTT<br>(SEQ ID NO: 76)<br>TTUUUGACCAUGAAAGGGGG-5<br>(SEQ ID NO: 75) | ++ | 26% | 12% |
| 6-3B | Specific modification (2'-deoxy-2'-fluoro)<br>5-GAAACUGG<u>UA</u>CUUUCCCCCTT<br>(SEQ ID NO: 76)<br>TTCUUUGACC<u>AU</u>GAAAGGGGG-5<br>(SEQ ID NO: 77) | ++ | 58% | 8% |

TABLE 7

| gene | Human BIC(NR_001458.3) (SEQ ID NO: 40) SIRNA | Locus Stability | 818-836 BP Expression inhibition ratio | Growth inhibition ratio |
|---|---|---|---|---|
| 7-1 | Unmodified siRNA<br>5-UUUCCCCCAGGUAACGAUUTT<br>(SEQ ID NO: 78)<br>TTAAAGGGGGUCCAUUGCUAA-5<br>(SEQ ID NO: 79) | + | 70% | 0% |

TABLE 7-continued

| gene | Human BIC(NR_001458.3) (SEQ ID NO: 40) SIRNA | Locus Stability | 818-836 BP | |
|---|---|---|---|---|
| | | | Expression inhibition ratio | Growth inhibition ratio |
| 7-2 | Random modification (2'-deoxy-2'-fluoro)<br>5-UUUCCCCCAGGUAACGAUUTT<br>(SEQ ID NO: 80)<br>TTAAAGGGGUCCAUUGCUAA-5<br>(SEQ ID NO: 81) | ++ | 68% | 21% |
| 7-3A | Specific modification (2'-deoxy-2'-fluoro)<br>5-UUUCCCCCAGGUAACGAUUTT<br>(SEQ ID NO: 82)<br>TTAAAGGGGUCCAUUGCUAA-5<br>(SEQ ID NO: 79) | ++ | 78% | 15% |
| 7-3B | Specific modification (2'-deoxy-2'-fluoro)<br>5-UUUCCCCCAGGUAACGAUUTT<br>(SEQ ID NO: 83)<br>TTAAAGGGGUCCAUUGCUAA-5<br>(SEQ ID NO: 84) | ++ | 75% | 8% |

TABLE 8

| gene | Human BIC(NR_001458.3) (SEQ ID NO: 40) SIRNA | Locus Stability | 822-840 BP | |
|---|---|---|---|---|
| | | | Expression inhibition ratio | Growth inhibition ratio |
| 8-1 | Unmodified siRNA<br>5-CCCCAGGUAACGAUUUUCUTT<br>(SEQ ID NO: 85)<br>TTGGGGUCCAUUGCUAAAAGA-5<br>(SEQ ID NO: 86) | + | 86% | 0% |
| 8-2 | Random modification (2'-O-methyl)<br>5-CCCCAGGUAACGAUUUUCUTT<br>(SEQ ID NO: 87)<br>TTGGGGUCCAUUGCUAAAAGA-5<br>(SEQ ID NO: 88) | ++ | 69% | 53% |
| 8-3A | Specific modification (2'-O-methyl)<br>5-CCCCAGGUAACGAUUUUCUTT<br>(SEQ ID NO: 89)<br>TTGGGGUCCAUUGCUAAAAGA-5<br>(SEQ ID NO: 86) | ++ | 79% | 12% |
| 8-3B | Specific modification (2'-O-methyl)<br>5-CCCCAGGUAACGAUUUUCUTT<br>(SEQ ID NO: 90)<br>TTGGGGUCCAUUGCUAAAAGA-5<br>(SEQ ID NO: 91) | ++ | 70% | 5% |

TABLE 9

| gene | Human BIC(NR_001458.3) (SEQ ID NO: 40) SIRNA | Locus Stability | 889-907 BP | |
|---|---|---|---|---|
| | | | Expression inhibition ratio | Growth inhibition ratio |
| 9-1 | Unmodified siRNA<br>5-GGGAAACUGAAAGGCUAUGTT<br>(SEQ ID NO: 92)<br>TTCCCUUUGACUUUCCGAUAC-5<br>(SEQ ID NO: 93) | + | 57% | 0% |
| 9-2 | Random modification (2'-deoxy-2'-fluoro)<br>5-GGGAAACUGAAAGGCUAUGTT<br>(SEQ ID NO: 92)<br>TTCCCUUUGACUUUCCGAUAC-5<br>(SEQ ID NO: 94) | + | 6% | 47% |

TABLE 9-continued

| | | | 889-907 BP | |
|---|---|---|---|---|
| gene | Human BIC(NR_001458.3) (SEQ ID NO: 40) SIRNA | Locus Stability | Expression inhibition ratio | Growth inhibition ratio |
| 9-3A | Specific modification (2'-deoxy-2'-fluoro)<br>5-GGGAAACUGAAAGGCUAUGTT<br>(SEQ ID NO: 95)<br>TTCCCUUUGACUUUCCGAUAC-5<br>(SEQ ID NO: 93) | ++ | 51% | 14% |
| 9-3B | Specific modification (2'-deoxy-2'-fluoro)<br>5-GGGAAACUGAAAGGCUAUGTT<br>(SEQ ID NO: 96)<br>TTCCCUUUGACUUUCCGAUAC-5<br>(SEQ ID NO: 93) | ++ | 50% | 4% |

TABLE 10

| | | | 1084-1102 BP | |
|---|---|---|---|---|
| gene | Human BIC(NR_001458.3) (SEQ ID NO: 40) SIRNA | Locus Stability | Expression inhibition ratio | Growth inhibition ratio |
| 10-1 | Unmodified siRNA<br>5-GCGAGCAGAGAAUCUACCUTT<br>(SEQ ID NO: 97)<br>TTCGCUCGUCUCUUAGAUGGA-5<br>(SEQ ID NO: 98) | + | 97% | 0% |
| 10-2 | Random modification (2'-O-methyl)<br>5-GCGAGCAGAGAAUCUACCUTT<br>(SEQ ID NO: 99)<br>TTCGCUCGUCUCUUAGAUGGA-5<br>(SEQ ID NO: 98) | ++ | 65% | 41% |
| 10-3A | Specific modification (2'-O-methyl)<br>5-GCGAGCAGAGAAUCUACCUTT<br>(SEQ ID NO: 100)<br>TTCGCUCGUCUCUUAGAUGGA-5<br>(SEQ ID NO: 101) | ++ | 90% | 9% |
| 10-3B | Specific modification (2'-O-methyl)<br>5-GCGAGCAGAGAAUCUACCUTT<br>(SEQ ID NO: 102)<br>TTCGCUCGUCUCUUAGAUGGA-5<br>(SEQ ID NO: 103) | ++ | 90% | 5% |

TABLE 11

| | | | 1088-1106 BP | |
|---|---|---|---|---|
| gene | Human BIC(NR_001458.3) (SEQ ID NO: 40) SIRNA | Locus Stability | Expression inhibition ratio | Growth inhibition ratio |
| 11-1 | Unmodified siRNA<br>5-GCAGAGAAUCUACCUUUCCTT<br>(SEQ ID NO: 104)<br>TTCGUCUCUUAGAUGGAAAGG-5<br>(SEQ ID NO: 105) | + | 79% | 0% |
| 11-2 | Random modification (2'-O-methyl)<br>5-GCAGAGAAUCUACCUUUCCTT<br>(SEQ ID NO: 106)<br>TTCGUCUCUUAGAUGGAAAGG-5<br>(SEQ ID NO: 107) | ++ | 13% | 38% |
| 11-3A | Specific modification (2'-O-methyl)<br>5-GCAGAGAAUCUACCUUUCCTT<br>(SEQ ID NO: 108)<br>TTCGUCUCUUAGAUGGAAAGG-5<br>(SEQ ID NO: 105) | +++ | 65% | 12% |

TABLE 11-continued

| | | | 1088-1106 BP | |
|---|---|---|---|---|
| gene | Human BIC(NR_001458.3) (SEQ ID NO: 40) SIRNA | Locus Stability | Expression inhibition ratio | Growth inhibition ratio |
| 11-3B | Specific modification (2'-O-methyl)<br>5-GCAGAGAAUCUACCUUUCCTT<br>(SEQ ID NO: 109)<br>TTCGUCUCUUAGAUGGAAAGG-5<br>(SEQ ID NO: 110) | ++ | 75% | 5% |

TABLE 12

| | | | 1099-1117 BP | |
|---|---|---|---|---|
| gene | Human BIC(NR_001458.3) (SEQ ID NO: 40) SIRNA | Locus Stability | Expression inhibition ratio | Growth inhibition ratio |
| 12-1 | Unmodified siRNA<br>5-ACCUUUCCACUUCUAAGCCTT<br>(SEQ ID NO: 111)<br>TTUGGAAAGGUGAAGAUUCGG-5<br>(SEQ ID NO: 112) | + | 84% | 0% |
| 12-2 | Random modification (2'-O-methyl)<br>5-ACCUUUCCACUUCUAAGCCTT<br>(SEQ ID NO: 113)<br>TTUGGAAAGGUGAAGAUUCGG-5<br>(SEQ ID NO: 112) | ++ | 75% | 41% |
| 12-3A | Specific modification (2'-O-methyl)<br>5-ACCUUUCCACUUCUAAGCCTT<br>(SEQ ID NO: 111)<br>TTUGGAAAGGUGAAGAUUCGG-5<br>(SEQ ID NO: 114) | ++ | 80% | 15% |
| 12-3B | Specific modification (2'-O-methyl)<br>5-ACCUUUCCACUUCUAAGCCTT<br>(SEQ ID NO: 115)<br>TTUGGAAAGGUGAAGAUUCGG-5<br>(SEQ ID NO: 116) | ++ | 75% | 6% |

TABLE 13

| | | | 1111-1129 BP | |
|---|---|---|---|---|
| gene | Human BIC(NR_001458.3) (SEQ ID NO: 40) SIRNA | Locus Stability | Expression inhibition ratio | Growth inhibition ratio |
| 13-1 | Unmodified siRNA<br>5-CUAAGCCUGUUUCUUCCUCTT<br>(SEQ ID NO: 117)<br>TTGAUUCGGACAAAGAAGGAG-5<br>(SEQ ID NO: 118) | + | 90% | 0% |
| 13-2 | Random modification (2'-deoxy-2'-fluoro)<br>5-CUAAGCCUGUUUCUUCCUCTT<br>(SEQ ID NO: 119)<br>TTGAUUCGGACAAAGAAGGAG-5<br>(SEQ ID NO: 120) | ++ | 75% | 57% |
| 13-3A | Specific modification (2'-deoxy-2'-fluoro)<br>5-CUAAGCCUGUUUCUUCCUCTT<br>(SEQ ID NO: 121)<br>TTGAUUCGGACAAAGAAGGAG-5<br>(SEQ ID NO: 122) | ++ | 85% | 12% |
| 13-3B | Specific modification (2'-deoxy-2'-fluoro)<br>5-CUAAGCCUGUUUCUUCCUCTT<br>(SEQ ID NO: 123)<br>TTGAUUCGGACAAAGAAGGAG-5<br>(SEQ ID NO: 118) | ++ | 82% | 4% |

TABLE 14

| gene | Human KAZRIN(NM_201628) (SEQ ID NO: 1) SIRNA | Locus Stability | 2456-2474 BP Expression inhibition ratio | Growth inhibition ratio |
|---|---|---|---|---|
| 14-1 | Unmodified siRNA<br>5-GAAGAUAGGAAGGGGCUUCTT<br>(SEQ ID NO: 124)<br>TTCUUCUAUCCUUCCCCGAAG-5<br>(SEQ ID NO: 125) | + | 55% | 0% |
| 14-2 | Random modification (2'-deoxy-2'-fluoro)<br>5-GAAGAUAGGAAGGGGCUUCTT<br>(SEQ ID NO: 124)<br>TTCUUCUAUCCUUCCCCGAAG-5<br>(SEQ ID NO: 126) | ++ | 5% | 23% |
| 14-3A | Specific modification (2'-deoxy-2'-fluoro)<br>5-GAAG<u>AU</u>AGGAAGGGGCUUCTT<br>(SEQ ID NO: 127)<br>TTCUUC<u>UA</u>UCCUUCCCCGAAG-5<br>(SEQ ID NO: 125) | ++ | 45% | 9% |
| 14-3B | Specific modification (2'-deoxy-2'-fluoro)<br>5-GAAG<u>AU</u>AGGAAGGGGCUUCTT<br>(SEQ ID NO: 128)<br>TTCUUCU<u>AU</u>CCUUCCCCGAAG-5<br>(SEQ ID NO: 129) | ++ | 56% | 4% |

TABLE 15

| gene | Human KAZRIN(NM_201628) (SEQ ID NO: 1) SIRNA | Locus Stability | 294-312 BP Expression inhibition ratio | Growth inhibition ratio |
|---|---|---|---|---|
| 15-1 | Unmodified siRNA<br>5-AAUAAGCAGCUCGCGCUCCTT<br>(SEQ ID NO: 130)<br>TTUUAUUCGUCGAGCGCGAGG-5<br>(SEQ ID NO: 131) | + | 73% | 0% |
| 15-2 | Random modification (2'-O-methyl)<br>5-AAUAAGCAGCUCGCGCUCCTT<br>(SEQ ID NO: 132)<br>TTUUAUUCGUCGAGCGCGAGG-5<br>(SEQ ID NO: 131) | ++ | 64% | 23% |
| 15-3A | Specific modification (2'-O-methyl)<br>5-AA<u>UA</u>AGCAGCUCGCGCUCCTT<br>(SEQ ID NO: 133)<br>TTUUA<u>UU</u>CG<u>U</u>CGAGCGCGAGG-5<br>(SEQ ID NO: 134) | ++ | 68% | 12% |
| 15-3B | Specific modification (2'-O-methyl)<br>5-AA<u>U</u>AAGCAGCUCGCGCUCCTT<br>(SEQ ID NO: 135)<br>TTUUA<u>U</u>UCGUCGAGCGCGAGG-5<br>(SEQ ID NO: 136) | ++ | 69% | 4% |

TABLE 16

| gene | Human KAZRIN(NM_201628) (SEQ ID NO: 1) SIRNA | Locus Stability | 673-691 BP Expression inhibition ratio | Growth inhibition ratio |
|---|---|---|---|---|
| 16-1 | Unmodified siRNA<br>5-UAGCCAGAGCCAAAGAAGCTT<br>(SEQ ID NO: 137)<br>TTAUCGGUCUCGGUUUCUUCG-5<br>(SEQ ID NO: 138) | + | 93% | 0% |

TABLE 16-continued

| gene | Human KAZRIN(NM_201628) (SEQ ID NO: 1) SIRNA | Locus Stability | 673-691 BP | |
|---|---|---|---|---|
| | | | Expression inhibition ratio | Growth inhibition ratio |
| 16-2 | Random modification (2'-O-methyl)<br>5-UAGCCAGAGCCAAAGAAGCTT<br>(SEQ ID NO: 139)<br>TTAUCGGUCUCGGUUUCUUCG-5<br>(SEQ ID NO: 140) | ++ | 75% | 57% |
| 16-3A | Specific modification (2'-O-methyl)<br>5-UAGCCAGAGCCAAAGAAGCTT<br>(SEQ ID NO: 141)<br>TTAUCGGUCUCGGUUUCUUCG-5<br>(SEQ ID NO: 142) | ++ | 85% | 12% |
| 16-3B | Specific modification (2'-O-methyl)<br>5-UAGCCAGAGCCAAAGAAGCTT<br>(SEQ ID NO: 143)<br>TTAUCGGUCUCGGUUUCUUCG-5<br>(SEQ ID NO: 144) | ++ | 82% | 4% |

TABLE 17

| gene | Human KAZRIN(NM_201628) (SEQ ID NO: 1) SIRNA | Locus Stability | 1012-1030 BP | |
|---|---|---|---|---|
| | | | Expression inhibition ratio | Growth inhibition ratio |
| 17-1 | Unmodified siRNA<br>5-AACAGUCCUUAGCUACGCUTT<br>(SEQ ID NO: 145)<br>TTUUGUCAGGAAUCGAUGCGA-5<br>(SEQ ID NO: 146) | + | 49% | 0% |
| 17-2 | Random modification (2'-O-methyl)<br>5-AACAGUCCUUAGCUACGCUTT<br>(SEQ ID NO: 147)<br>TTUUGUCAGGAAUCGAUGCGA-5<br>(SEQ ID NO: 146) | + | 35% | 57% |
| 17-3A | Specific modification (2'-O-methyl)<br>5-AACAGUCCUUAGCUACGCUTT<br>(SEQ ID NO: 148)<br>TTUUGUCAGGAAUCGAUGCGA-5<br>(SEQ ID NO: 149) | ++ | 85% | 12% |
| 17-3B | Specific modification (2'-O-methyl)<br>5-AACAGUCCUUAGCUACGCUTT<br>(SEQ ID NO: 150)<br>TTUUGUCAGGAAUCGAUGCGA-5<br>(SEQ ID NO: 151) | ++ | 82% | 4% |

TABLE 18

| gene | Human KAZRIN(NM_201628) (SEQ ID NO: 1) SIRNA | Locus Stability | 1383-1401 BP | |
|---|---|---|---|---|
| | | | Expression inhibition ratio | Growth inhibition ratio |
| 18-1 | Unmodified siRNA<br>5-CUAGAGGAUCUUGAAGACCTT<br>(SEQ ID NO: 152)<br>TTGAUCUCCUAGAACUUCUGG-5<br>(SEQ ID NO: 153) | + | 72% | 0% |
| 18-2 | Random modification (2'-deoxy-2'-fluoro)<br>5-CUAGAGGAUCUUGAAGACCTT<br>(SEQ ID NO: 154)<br>TTGAUCUCCUAGAACUCUGG-5<br>(SEQ ID NO: 155) | ++ | 12% | 42% |

TABLE 18-continued

| gene | Human KAZRIN(NM_201628) (SEQ ID NO: 1) SIRNA | Locus Stability | 1383-1401 BP Expression inhibition ratio | Growth inhibition ratio |
|---|---|---|---|---|
| 18-3A | Specific modification (2'-deoxy-2'-fluoro)<br>5-CUAGAGGAUCUUGAAGACCTT<br>(SEQ ID NO: 156)<br>TTGAUCUCCUAGAACUUCUGG-5<br>(SEQ ID NO: 157) | ++ | 67% | 12% |
| 18-3B | Specific modification (2'-deoxy-2'-fluoro)<br>5-CUAGAGGAUCUUGAAGACCTT<br>(SEQ ID NO: 158)<br>TTGAUCUCCUAGAACUUCUGG-5<br>(SEQ ID NO: 159) | ++ | 82% | 4% |

TABLE 19

| gene | Human KAZRIN(NM_201628) (SEQ ID NO: 1) SIRNA | Locus Stability | 2151-2169 BP Expression inhibition ratio | Growth inhibition ratio |
|---|---|---|---|---|
| 19-1 | Unmodified siRNA<br>5-AUCGACCUGAAGGAGUACGTT<br>(SEQ ID NO: 160)<br>TTUAGCUGGACUUCCUCAUGC-5<br>(SEQ ID NO: 161) | + | 52% | 0% |
| 19-2 | Random modification (2'-deoxy-2'-fluoro)<br>5-AUCGACCUGAAGGAGUACGTT<br>(SEQ ID NO: 162)<br>TTUAGCUGGACUUCCUCAUGC-5<br>(SEQ ID NO: 163) | ++ | 21% | 49% |
| 19-3A | Specific modification (2'-deoxy-2'-fluoro)<br>5-AUCGACCUGAAGGAGUACGTT<br>(SEQ ID NO: 164)<br>TTUAGCUGGACUUCCUCAUGC-5<br>(SEQ ID NO: 165) | ++ | 46% | 9% |
| 19-3B | Specific modification (2'-deoxy-2'-fluoro)<br>5-AUCGACCUGAAGGAGUACGTT<br>(SEQ ID NO: 166)<br>TTUAGCUGGACUUCCUCAUGC-5<br>(SEQ ID NO: 167) | ++ | 82% | 4% |

TABLE 20

| gene | Human KAZRIN(NM_201628) (SEQ ID NO: 1) SIRNA | Locus Stability | 2459-2477 BP Expression inhibition ratio | Growth inhibition ratio |
|---|---|---|---|---|
| 20-1 | Unmodified siRNA<br>5-GAUAGGAAGGGGCUUCAGCTT<br>(SEQ ID NO: 168)<br>TTCUAUCCUUCCCCGAAGUCG-5<br>(SEQ ID NO: 169) | + | 53% | 0% |
| 20-2 | Random modification (2'-O-methyl)<br>5-GAUAGGAAGGGGCUUCAGCTT<br>(SEQ ID NO: 168)<br>TTCUAUCCUUCCCCGAAGUCG-5<br>(SEQ ID NO: 170) | ++ | 12% | 52% |
| 20-3A | Specific modification (2'-O-methyl)<br>5-GAUAGGAAGGGGCUUCAGCTT<br>(SEQ ID NO: 171)<br>TTCUAUCCUUCCCCGAAGUCG-5<br>(SEQ ID NO: 172) | ++ | 42% | 16% |

TABLE 20-continued

| gene | Human KAZRIN(NM_201628) (SEQ ID NO: 1) SIRNA | Locus Stability | 2459-2477 BP Expression inhibition ratio | Growth inhibition ratio |
|---|---|---|---|---|
| 20-3B | Specific modification (2'-O-methyl)<br>5-GAU AGGAAGGGGCUUCAGCTT<br>(SEQ ID NO: 173)<br>TTCU AU CCUUCCCCGAAGUCG-5<br>(SEQ ID NO: 174) | ++ | 41% | 6% |

TABLE 21

| gene | Human KAZRIN(NM_201628) (SEQ ID NO: 1) SIRNA | Locus Stability | 2935-2953 BP Expression inhibition ratio | Growth inhibition ratio |
|---|---|---|---|---|
| 21-1 | Unmodified siRNA<br>5-AGUCCCUGGAGCCUUAAACTT<br>(SEQ ID NO: 175)<br>TTUCAGGGACCUCGGAAUUUG-5<br>(SEQ ID NO: 176) | + | 72% | 0% |
| 21-2 | Random modification (2'-O-methyl)<br>5-AGUCCCUGGAGCCUUAAACTT<br>(SEQ ID NO: 177)<br>TTUCAGGGACCUCGGAAUUUG-5<br>(SEQ ID NO: 176) | + | 68% | 41% |
| 21-3A | Specific modification (2'-O-methyl)<br>5-AGUCCCUGGAGCCUUAAACTT<br>(SEQ ID NO: 178)<br>TTUCAGGGACCUCGGAAUUUG-5<br>(SEQ ID NO: 179) | ++ | 65% | 12% |
| 21-3B | Specific modification (2'-O-methyl)<br>5-AGUCCCUGGAGCCUUAAACTT<br>(SEQ ID NO: 180)<br>TTUCAGGGACCUCGGAAUUUG-5<br>(SEQ ID NO: 181) | ++ | 62% | 5% |

TABLE 22

| gene | Human KAZRIN(NM_201628) (SEQ ID NO: 1) SIRNA | Locus Stability | 3327-3345 BP Expression inhibition ratio | Growth inhibition ratio |
|---|---|---|---|---|
| 22-1 | Unmodified siRNA<br>5-AGCCACAUUUCUAGGAGAUTT<br>(SEQ ID NO: 182)<br>TTUCGGUGUAAAGAUCCUCUA-5<br>(SEQ ID NO: 183) | + | 39% | 0% |
| 22-2 | Random modification (2'-O-methyl)<br>5-AGCCACAUUUCUAGGAGAUTT<br>(SEQ ID NO: 184)<br>TTUCGGUGUAAAGAUCCUCUA-5<br>(SEQ ID NO: 183) | ++ | 19% | 52% |
| 22-3A | Specific modification (2'-O-methyl)<br>5-AGCCACAUUUCUAGGAGAUTT<br>(SEQ ID NO: 185)<br>TTUCGGUGUAAAGAUCCUCUA-5<br>(SEQ ID NO: 186) | ++ | 26% | 16% |
| 22-3B | Specific modification (2'-O-methyl)<br>5-AGCCACAUUUCUAGGAGAUTT<br>(SEQ ID NO: 187)<br>TTUCGGUGUAAAGAUCCUCUA-5<br>(SEQ ID NO: 188) | ++ | 29% | 4% |

TABLE 23

|  |  |  | 3449-3467 BP | |
|---|---|---|---|---|
| gene | Human KAZRIN(NM_201628) (SEQ ID NO: 1) SIRNA | Locus Stability | Expression inhibition ratio | Growth inhibition ratio |
| 23-1 | Unmodified siRNA<br>5-GAUUCCAAACCCCACUAUCTT (SEQ ID NO: 189)<br>TTCUAAGGUUUGGGGUGAUAG-5 (SEQ ID NO: 190) | + | 73% | 0% |
| 23-2 | Random modification (2'-O-methyl)<br>5-GAUUCCAAACCCCACUAUCTT (SEQ ID NO: 191)<br>TTCUAAGGUUUGGGGUGAUAG-5 (SEQ ID NO: 190) | ++ | 54% | 57% |
| 23-3A | Specific modification (2'-O-methyl)<br>5-GAUUCCAAACCCCACUAUCTT (SEQ ID NO: 192)<br>TTCUAAGGUUUGGGGUGAUAG-5 (SEQ ID NO: 193) | ++ | 67% | 13% |
| 23-3B | Specific modification (2'-O-methyl)<br>5-GAUUCCAAACCCCACUAUCTT (SEQ ID NO: 194)<br>TTCUAAGGUUUGGGGUGAUAG-5 (SEQ ID NO: 195) | ++ | 69% | 5% |

TABLE 24

|  |  |  | 3751-3769 BP | |
|---|---|---|---|---|
| gene | human KAZRIN(NM_201628) (SEQ ID NO: 1) SIRNA | Locus Stability | Expression inhibition ratio | Growth inhibition ratio |
| 24-1 | Unmodified siRNA<br>5-GAUACUUCUGGUUCCCUCCTT (SEQ ID NO: 196)<br>TTCUAUGAAGACCAAGGGAGG-5 (SEQ ID NO: 197) | + | 53% | 0% |
| 24-2 | Random modification (2'-O-methyl)<br>5-GAUACUUCUGGUUCCCUCCTT (SEQ ID NO: 198)<br>TTCUAUGAAGACCAAGGGAGG-5 (SEQ ID NO: 197) | ++ | 45% | 60% |
| 24-3A | Specific modification (2'-O-methyl)<br>5-GAUACUUCUGGUUCCCUCCTT (SEQ ID NO: 199)<br>TTCUAUGAAGACCAAGGGAGG-5 (SEQ ID NO: 200) | ++ | 45% | 10% |
| 24-3B | Specific modification (2'-O-methyl)<br>5-GAUACUUCUGGUUCCCUCCTT (SEQ ID NO: 201)<br>TTCUAUGAAGACCAAGGGAGG-5 (SEQ ID NO: 202) | ++ | 46% | 5% |

TABLE 25

|  |  |  | 5508-5526 BP | |
|---|---|---|---|---|
| gene | Human KAZRIN(NM_201628) (SEQ ID NO: 1) SIRNA | Locus Stability | Expression inhibition ratio | Growth inhibition ratio |
| 25-1 | Unmodified siRNA<br>5-AGAGAAGGGCGUCUCUACATT (SEQ ID NO: 203)<br>TTUCUCUUCCCGCAGAGAUGU-5 (SEQ ID NO: 204) | + | 83% | 0% |

TABLE 25-continued

| | | | 5508-5526 BP | |
|---|---|---|---|---|
| gene | Human KAZRIN(NM_201628) (SEQ ID NO: 1) SIRNA | Locus Stability | Expression inhibition ratio | Growth inhibition ratio |
| 25-2 | Random modification (2'-deoxy-2'-fluoro)<br>5-AGAGAAGGGCGUCUCUACATT<br>(SEQ ID NO: 205)<br>TTUCUCUUCCCGCAGAGAUGU-5<br>(SEQ ID NO: 204) | ++ | 75% | 49% |
| 25-3A | Specific modification (2'-deoxy-2'-fluoro)<br>5-AGAGAAGGGCGUCUC<u>UA</u>CATT<br>(SEQ ID NO: 206)<br>TTUCUCUUCCCGCAGAG<u>AUGU</u>-5<br>(SEQ ID NO: 207) | ++ | 71% | 16% |
| 25-3B | Specific modification (2'-deoxy-2'-fluoro)<br>5-AGAGAAGGGCGUCUC<u>UA</u>CATT<br>(SEQ ID NO: 208)<br>TTUCUCUUCCCGCAGAG<u>AU</u>GU-5<br>(SEQ ID NO: 209) | ++ | 69% | 4% |

TABLE 26

| | | | 5939-5957 BP | |
|---|---|---|---|---|
| gene | Human KAZRIN(NM_201628) (SEQ ID NO: 1) SIRNA | Locus Stability | Expression inhibition ratio | Growth inhibition ratio |
| 26-1 | Unmodified siRNA<br>5-AGUUUCUAGGGCCGUGGCCTT<br>(SEQ ID NO: 210)<br>TTUCAAAGAUCCCGGCACCGG-5<br>(SEQ ID NO: 211) | + | 90% | 0% |
| 26-2 | Random modification (2'-deoxy-2'-fluoro)<br>5-AGUUUCUAGGGCCGUGGCCTT<br>(SEQ ID NO: 212)<br>TTUCAAAGAUCCCGGCACCGG-5<br>(SEQ ID NO: 211) | ++ | 75% | 61% |
| 26-3A | Specific modification (2'-deoxy-2'-fluoro)<br>5-AGUUUC<u>UA</u>GGGCCGUGGCCTT<br>(SEQ ID NO: 213)<br>TTUCAAAG<u>AU</u>CCCGGCACCGG-5<br>(SEQ ID NO: 214) | ++ | 85% | 13% |
| 26-3B | Specific modification (2'-deoxy-2'-fluoro)<br>5-AGUUUC<u>UA</u>GGGCCGUGGCCTT<br>(SEQ ID NO: 215)<br>TTUCAAAG<u>AU</u>CCCGGCACCGG-5<br>(SEQ ID NO: 216) | ++ | 82% | 7% |

TABLE 27

| | | | 587-605 BP | |
|---|---|---|---|---|
| gene | Human CDKN1B(NM_004064) (SEQ ID NO: 217) SIRNA | Locus Stability | Expression inhibition ratio | Growth inhibition ratio |
| 27-1 | Unmodified siRNA<br>5-GAAGAGUUAACCCGGGACUTT<br>(SEQ ID NO: 218)<br>TTCUUCUCAAUUGGGCCCUGA-5<br>(SEQ ID NO: 219) | + | 62% | 0% |
| 27-2 | Random modification (2'-O-methyl)<br>5-GAAGAGUUAACCCGGGACUTT<br>(SEQ ID NO: 220)<br>TTCUUCUCAAUUGGGCCCUGA-5<br>(SEQ ID NO: 219) | ++ | 17% | 61% |

TABLE 27-continued

| gene | Human CDKN1B(NM_004064) (SEQ ID NO: 217) SIRNA | Locus Stability | 587-605 BP Expression inhibition ratio | Growth inhibition ratio |
|---|---|---|---|---|
| 27-3A | Specific modification (2'-O-methyl)<br>5-GAAGAGUUAACCCGGGACUTT<br>(SEQ ID NO: 221)<br>TTCUUCUCAAUUGGGCCCUGA-5<br>(SEQ ID NO: 222) | ++ | 47% | 13% |
| 27-3B | Specific modification (2'-O-methyl)<br>5-GAAGAGUUAACCCGGGACUTT<br>(SEQ ID NO: 223)<br>TTCUUCUCAAUUGGGCCCUGA-5<br>(SEQ ID NO: 224) | ++ | 51% | 6% |

TABLE 28

| gene | Human CDKN1B(NM_004064) (SEQ ID NO: 217) SIRNA | Locus Stability | 808-826 BP Expression inhibition ratio | Growth inhibition ratio |
|---|---|---|---|---|
| 28-1 | Unmodified siRNA<br>5-CCGCCCGGCGGCGCCUUUATT<br>(SEQ ID NO: 225)<br>TTGGCGGGCCGCCGCGGAAAU-5<br>(SEQ ID NO: 226) | + | 95% | 0% |
| 28-2 | Random modification (2'-O-methyl)<br>5-CCGCCCGGCGGCGCCUUUATT<br>(SEQ ID NO: 227)<br>TTGGCGGGCCGCCGCGGAAAU-5<br>(SEQ ID NO: 226) | ++ | 49% | 52% |
| 28-3A | Specific modification (2'-O-methyl)<br>5-CCGCCCGGCGGCGCCUUUATT<br>(SEQ ID NO: 228)<br>TTGGCGGGCCGCCGCGGAAAU-5<br>(SEQ ID NO: 229) | ++ | 85% | 11% |
| 28-3B | Specific modification (2'-O-methyl)<br>5-CCGCCCGGCGGCGCCUUUATT<br>(SEQ ID NO: 230)<br>TTGGCGGGCCGCCGCGGAAAU-5<br>(SEQ ID NO: 231) | ++ | 82% | 4% |

TABLE 29

| gene | Human CDKN1B(NM_004064) (SEQ ID NO: 217) SIRNA | Locus Stability | 941-959 BP Expression inhibition ratio | Growth inhibition ratio |
|---|---|---|---|---|
| 29-1 | Unmodified siRNA<br>5-ACCGACGAUUCUUCUACUCTT<br>(SEQ ID NO: 232)<br>TTUGGCUGCUAAGAAGAUGAG-5<br>(SEQ ID NO: 233) | + | 73% | 0% |
| 29-2 | Random modification (2'-O-methyl)<br>5-ACCGACGAUUCUUCUACUCTT<br>(SEQ ID NO: 234)<br>TTUGGCUGCUAAGAAGAUGAG-5<br>(SEQ ID NO: 233) | ++ | 42% | 47% |
| 29-3A | Specific modification (2'-O-methyl)<br>5-ACCGACGAUUCUUCUACUCTT<br>(SEQ ID NO: 235)<br>TTUGGCUGCUAAGAAGAUGAG-5<br>(SEQ ID NO: 236) | ++ | 67% | 9% |

TABLE 29-continued

| | | | 941-959 BP | |
|---|---|---|---|---|
| gene | Human CDKN1B(NM_004064) (SEQ ID NO: 217) SIRNA | Locus Stability | Expression inhibition ratio | Growth inhibition ratio |
| 29-3B | Specific modification (2'-O-methyl)<br>5-ACCGACGAUUCUUCUACUCUTT<br>(SEQ ID NO: 235)<br>TTUGGCUGCUAAGAAGAUGAG-5<br>(SEQ ID NO: 237) | ++ | 68% | 4% |

TABLE 30

| | | | 2262-2280 BP | |
|---|---|---|---|---|
| gene | Human CDKN1B(NM_004064) (SEQ ID NO: 217) SIRNA | Locus Stability | Expression inhibition ratio | Growth inhibition ratio |
| 30-1 | Unmodified siRNA<br>5-GGUAGAAUAGGUUUUCCCCTT<br>(SEQ ID NO: 238)<br>TTCCAUCUUAUCCAAAAGGGG-5<br>(SEQ ID NO: 239) | + | 54% | 0% |
| 30-2 | Random modification (2'-O-methyl)<br>5-GGUAGAAUAGGUUUUCCCCTT<br>(SEQ ID NO: 240)<br>TTCCAUCUUAUCCAAAAGGGG-5<br>(SEQ ID NO: 239) | ++ | 11% | 71% |
| 30-3A | Specific modification (2'-O-methyl)<br>5-GGUAGAAUAGGUUUUCCCCTT<br>(SEQ ID NO: 241)<br>TTCCAUCUUAUCCAAAAGGGG-5<br>(SEQ ID NO: 242) | ++ | 45% | 10% |
| 30-3B | Specific modification (2'-O-methyl)<br>5-GGUAGAAUAGGUUUUCCCCTT<br>(SEQ ID NO: 243)<br>TTCCAUCUUAUCCAAAAGGGG-5<br>(SEQ ID NO: 244) | ++ | 82% | 3% |

TABLE 31

| | | | 15-33 BP | |
|---|---|---|---|---|
| gene | Human CDKN1B(NM_004064) (SEQ ID NO: 217) SIRNA | Locus Stability | Expression inhibition ratio | Growth inhibition ratio |
| 31-1 | Unmodified siRNA<br>5-UCCCUUCCACCGCCAUAUUTT<br>(SEQ ID NO: 245)<br>TTAGGGAAGGUGGCGGUAUAA-5<br>(SEQ ID NO: 246) | + | 58% | 0% |
| 31-2 | Random modification (2'-O-methyl)<br>5-UCCCUUCCACCGCCAUAUUTT<br>(SEQ ID NO: 247)<br>TTAGGGAAGGUGGCGGUAUAA-5<br>(SEQ ID NO: 246) | ++ | 11% | 59% |
| 31-3A | Specific modification (2'-O-methyl)<br>5-UCCCUUCCACCGCCAUAUUTT<br>(SEQ ID NO: 248)<br>TTAGGGAAGGUGGCGGUAUAA-5<br>(SEQ ID NO: 249) | ++ | 47% | 13% |
| 31-3B | Specific modification (2'-O-methyl)<br>5-UCCCUUCCACCGCCAUAUUTT<br>(SEQ ID NO: 250)<br>TTAGGGAAGGUGGCGGUAUAA-5<br>(SEQ ID NO: 251) | ++ | 49% | 2% |

TABLE 32

| gene | Human CDKN1B(NM_004064) (SEQ ID NO: 217) SIRNA | Locus Stability | 485-503 BP Expression inhibition ratio | Growth inhibition ratio |
|---|---|---|---|---|
| 32-1 | Unmodified siRNA<br>5-CGAGUGUCUAACGGGAGCCTT<br>(SEQ ID NO: 252)<br>TTGCUCACAGAUUGCCCUCGG-5<br>(SEQ ID NO: 253) | + | 70% | 0% |
| 32-2 | Random modification (2'-O-methyl)<br>5-CGAGUGUCUAACGGGAGCCTT<br>(SEQ ID NO: 254)<br>TTGCUCACAGAUUGCCCUCGG-5<br>(SEQ ID NO: 253) | ++ | 25% | 56% |
| 32-3A | Specific modification (2'-O-methyl)<br>5-CGAGUGUCUAACGGGAGCCTT<br>(SEQ ID NO: 255)<br>TTGCUCACAGAUUGCCCUCGG-5<br>(SEQ ID NO: 256) | ++ | 65% | 9% |
| 32-3B | Specific modification (2'-O-methyl)<br>5-CGAGUGUCUAACGGGAGCCTT<br>(SEQ ID NO: 252)<br>TTGCUCACAGAUUGCCCUCGG-5<br>(SEQ ID NO: 257) | ++ | 68% | 2% |

TABLE 33

| gene | Human CDKN1B(NM_004064) (SEQ ID NO: 217) SIRNA | Locus Stability | 581-599 BP Expression inhibition ratio | Growth inhibition ratio |
|---|---|---|---|---|
| 33-1 | Unmodified siRNA<br>5-GACCACGAAGAGUUAACCCTT<br>(SEQ ID NO: 258)<br>TTCUGGUGCUUCUCAAUUGGG-5<br>(SEQ ID NO: 259) | + | 91% | 0% |
| 33-2 | Random modification (2'-deoxy-2'-fluoro)<br>5-GACCACGAAGAGUUAACCCTT<br>(SEQ ID NO: 260)<br>TTCUGGUGCUUCUCAAUUGGG-5<br>(SEQ ID NO: 259) | ++ | 51% | 59% |
| 33-3A | Specific modification (2'-deoxy-2'-fluoro)<br>5-GACCACGAAGAGUUAACCCTT<br>(SEQ ID NO: 261)<br>TTCGGUGCUUCUCAAUUGGG-5<br>(SEQ ID NO: 262) | ++ | 85% | 13% |
| 33-3B | Specific modification (2'-deoxy-2'-fluoro)<br>5-GACCACGAAGAGUUAACCCTT<br>(SEQ ID NO: 263)<br>TTCUGGUGCUUCUCAAUUGGG-5<br>(SEQ ID NO: 264) | ++ | 82% | 7% |

TABLE 34

| gene | Human CDKN1B(NM_004064) (SEQ ID NO: 217) SIRNA | Locus Stability | 591-609 BP Expression inhibition ratio | Growth inhibition ratio |
|---|---|---|---|---|
| 34-1 | Unmodified siRNA<br>5-AGUUAACCCGGGACUUGGATT<br>(SEQ ID NO: 265)<br>TTUCAAUUGGGCCCUGAACCU-5<br>(SEQ ID NO: 266) | + | 97% | 0% |

TABLE 34-continued

| | | | 591-609 BP | |
|---|---|---|---|---|
| gene | Human CDKN1B(NM_004064) (SEQ ID NO: 217) SIRNA | Locus Stability | Expression inhibition ratio | Growth inhibition ratio |
| 34-2 | Random modification (2'-deoxy-2'-fluoro)<br>5-AGUUAACCCGGGACUUGGATT<br>(SEQ ID NO: 267)<br>TTUCAAUUGGGCCCUGAACCU-5<br>(SEQ ID NO: 266) | ++ | 65% | 57% |
| 34-3A | Specific modification (2'-deoxy-2'-fluoro)<br>5-AGU<u>UA</u>ACCCGGGACU<u>U</u>GGATT<br>(SEQ ID NO: 268)<br>TTCA<u>AU</u>UGGGCCCUGA<u>AC</u>CU-5<br>(SEQ ID NO: 269) | ++ | 85% | 9% |
| 34-3B | Specific modification (2'-deoxy-2'-fluoro)<br>5-AGU<u>UA</u>ACCCGGGACUUGGATT<br>(SEQ ID NO: 270)<br>TTUCA<u>AU</u>UGGGCCCUGAACCU-5<br>(SEQ ID NO: 271) | ++ | 86% | 4% |

TABLE 35

| | | | 669-687 BP | |
|---|---|---|---|---|
| gene | Human CDKN1B(NM_004064) (SEQ ID NO: 217) SIRNA | Locus Stability | Expression inhibition ratio | Growth inhibition ratio |
| 35-1 | Unmodified siRNA<br>5-AUCACAAACCCCUAGAGGGTT<br>(SEQ ID NO: 272)<br>TTUAGUGUUUGGGGAUCUCCC-5<br>(SEQ ID NO: 273) | + | 35% | 0% |
| 35-2 | Random modification (2'-O-methyl)<br>5-AUCACAAACCCCUAGAGGGTT<br>(SEQ ID NO: 274)<br>TTUAGUGUUUGGGGAUCUCCC-5<br>(SEQ ID NO: 273) | ++ | 9% | 51% |
| 35-3A | Specific modification (2'-O-methyl)<br>5-AU<u>CAC</u>AAACCCC<u>UAG</u>AGGGTT<br>(SEQ ID NO: 275)<br>TTAG<u>UG</u>UUUGGGG<u>AU</u>CUCCC-5<br>(SEQ ID NO: 276) | ++ | 27% | 10% |
| 35-3B | Specific modification (2'-O-methyl)<br>5-AUCACAAACCCC<u>UAG</u>AGGGTT<br>(SEQ ID NO: 277)<br>TTUAGUGUUUGGGG<u>AU</u>CUCCC-5<br>(SEQ ID NO: 278) | ++ | 29% | 4% |

TABLE 36

| | | | 674-692 BP | |
|---|---|---|---|---|
| gene | Human CDKN1B(NM_004064) (SEQ ID NO: 217) SIRNA | Locus Stability | Expression inhibition ratio | Growth inhibition ratio |
| 36-1 | Unmodified siRNA<br>5-AAACCCCUAGAGGGCAAGUTT<br>(SEQ ID NO: 279)<br>TTUUUGGGGAUCUCCCGUUCA-5<br>(SEQ ID NO: 280) | + | 81% | 0% |
| 36-2 | Random modification (2'-O-methyl)<br>5-AAACCCCUAGAGGGCAAGUTT<br>(SEQ ID NO: 281)<br>TTUUUGGGGAUCUCCCGUUCA-5<br>(SEQ ID NO: 280) | ++ | 62% | 54% |

TABLE 36-continued

|  |  |  | 674-692 BP | | |
| --- | --- | --- | --- | --- | --- |
| gene | Human CDKN1B(NM_004064) (SEQ ID NO: 217) SIRNA | Locus Stability | Expression inhibition ratio | Growth inhibition ratio |

| gene | Human CDKN1B(NM_004064) (SEQ ID NO: 217) SIRNA | Locus Stability | Expression inhibition ratio | Growth inhibition ratio |
| --- | --- | --- | --- | --- |
| 36-3A | Specific modification (2'-O-methyl)<br>5-AAACCCC<u>UAG</u>AGGGCAAGUTT<br>(SEQ ID NO: 282)<br>TTUUUGGGG<u>AU</u>CUCCCGUUCA-5<br>(SEQ ID NO: 283) | ++ | 78% | 11% |
| 36-3B | Specific modification (2'-O-methyl)<br>5-AAACCCC<u>UAG</u>AGGGCAAGUTT<br>(SEQ ID NO: 284)<br>TTUUUGGGG<u>AU</u>CUCCCGUUCA-5<br>(SEQ ID NO: 285) | ++ | 75% | 5% |

TABLE 37

|  |  |  | 835-853 BP | | |
| --- | --- | --- | --- | --- | --- |
| gene | Human CDKN1B(NM_004064) (SEQ ID NO: 217) SIRNA | Locus Stability | Expression inhibition ratio | Growth inhibition ratio |
| 37-1 | Unmodified siRNA<br>5-UCCGGCUAACUCUGAGGACTT<br>(SEQ ID NO: 286)<br>TTAGGCCGAUUGAGACUCCUG-5<br>(SEQ ID NO: 286) | + | 95% | 0% |
| 37-2 | Random modification (2'-deoxy-2'-fluoro)<br>5-UCCGGCUAACUCUGAGGACTT<br>(SEQ ID NO: 286)<br>TTAGGCCGAUUGAGACUCCUG-5<br>(SEQ ID NO: 286) | ++ | 41% | 61% |
| 37-3A | Specific modification (2'-deoxy-2'-fluoro)<br>5-UCCGGC<u>UAA</u>CUC<u>U</u>GAGGACTT<br>(SEQ ID NO: 286)<br>TTAGGCCG<u>AU</u>UGAGAC<u>U</u>CCUG-5<br>(SEQ ID NO: 290) | ++ | 85% | 9% |
| 37-3B | Specific modification (2'-deoxy-2'-fluoro)<br>5-UCCGGC<u>UAA</u>CUCUGAGGACTT<br>(SEQ ID NO: 291)<br>TTAGGCCG<u>AU</u>UGAGACUCCUG-5<br>(SEQ ID NO: 292) | ++ | 82% | 3% |

TABLE 38

|  |  |  | 943-961 BP | | |
| --- | --- | --- | --- | --- | --- |
| gene | Human CDKN1B(NM_004064) (SEQ ID NO: 217) SIRNA | Locus Stability | Expression inhibition ratio | Growth inhibition ratio |
| 38-1 | Unmodified siRNA<br>5-CGACGAUUCUUCUACUCAATT<br>(SEQ ID NO: 293)<br>TTGCUGCUAAGAAGAUGAGUU-5<br>(SEQ ID NO: 294) | + | 72% | 0% |
| 38-2 | Random modification (2'-deoxy-2'-fluoro)<br>5-CGACGAUUCUUCUACUCAATT<br>(SEQ ID NO: 295)<br>TTGCUGCUAAGAAGAUGAGUU-5<br>(SEQ ID NO: 294) | ++ | 56% | 34% |
| 38-3A | Specific modification (2'-deoxy-2'-fluoro)<br>5-CGAC<u>G</u>AUUCUU<u>CU</u>ACUCAATT<br>(SEQ ID NO: 296)<br>TTGCUGCUAAGAAG<u>AU</u>GAGUU-5<br>(SEQ ID NO: 297) | ++ | 62% | 9% |

TABLE 38-continued

| gene | Human CDKN1B(NM_004064) (SEQ ID NO: 217) SIRNA | Locus Stability | 943-961 BP Expression inhibition ratio | Growth inhibition ratio |
|---|---|---|---|---|
| 38-3B | Specific modification (2'-deoxy-2'-fluoro)<br>5-CGACGAUUCUUCUACUCAATT<br>(SEQ ID NO: 298)<br>TTGCUGCUAAGAAGAUGAGUU-5<br>(SEQ ID NO: 299) | ++ | 67% | 4% |

TABLE 39

| gene | Human CDKN1B(NM_004064) (SEQ ID NO: 217) SIRNA | Locus Stability | 1353-1371 BP Expression inhibition ratio | Growth inhibition ratio |
|---|---|---|---|---|
| 39-1 | Unmodified siRNA<br>5-UAAACUUUGGGGAAGGGAGTT<br>(SEQ ID NO: 300)<br>TTAUUUGAAACCCCUUCCCUC-5<br>(SEQ ID NO: 301) | + | 73% | 0% |
| 39-2 | Random modification (2'-O-methyl)<br>5-UAAACUUUGGGGAAGGGAGTT<br>(SEQ ID NO: 302)<br>TTAUUUGAAACCCCUUCCCUC-5<br>(SEQ ID NO: 301) | ++ | 34% | 48% |
| 39-3A | Specific modification (2'-O-methyl)<br>5-UAAACUUUGGGGAAGGGAGTT<br>(SEQ ID NO: 303)<br>TTAUUUGAAACCCCUUCCCUC-5<br>(SEQ ID NO: 304) | ++ | 67% | 11% |
| 39-3B | Specific modification (2'-O-methyl)<br>5-UAAACUUUGGGGAAGGGAGTT<br>(SEQ ID NO: 305)<br>TTAUUUGAAACCCCUUCCCUC-5<br>(SEQ ID NO: 306) | ++ | 72% | 3% |

TABLE 40

| gene | Human CDKN1B(NM_004064) (SEQ ID NO: 217) SIRNA | Locus Stability | 1401-1419 BP Expression inhibition ratio | Growth inhibition ratio |
|---|---|---|---|---|
| 40-1 | Unmodified siRNA<br>5-AGCGGGGUAUGAAGAGCUUTT<br>(SEQ ID NO: 307)<br>TTUCGCCCCAUACUUCUCGAA-5<br>(SEQ ID NO: 308) | + | 95% | 0% |
| 40-2 | Random modification (2'-O-methyl)<br>5-AGCGGGGUAUGAAGAGCUUTT<br>(SEQ ID NO: 309)<br>TTUCGCCCCAUACUUCUCGAA-5<br>(SEQ ID NO: 308) | ++ | 75% | 38% |
| 40-3A | Specific modification (2'-O-methyl)<br>5-AGCGGGGUAUGAAGAGCUUTT<br>(SEQ ID NO: 310)<br>TTUCGCCCCAUACUUCUCGAA-5<br>(SEQ ID NO: 311) | ++ | 85% | 13% |
| 40-3B | Specific modification (2'-O-methyl)<br>5-AGCGGGGUAUGAAGAGCUUTT<br>(SEQ ID NO: 312)<br>TTUCGCCCCAUACUUCUCGAA-5<br>(SEQ ID NO: 313) | ++ | 82% | 6% |

TABLE 41

| gene | Human CDKN1B(NM_004064) (SEQ ID NO: 217) SIRNA | Locus Stability | 1711-1729 BP Expression inhibition ratio | Growth inhibition ratio |
|---|---|---|---|---|
| 41-1 | Unmodified siRNA<br>5-CUCCCCAGUCUCUCUUAAATT<br>(SEQ ID NO: 314)<br>TTGAGGGGUCAGAGAGAAUUU-5<br>(SEQ ID NO: 315) | + | 72% | 0% |
| 41-2 | Random modification (2'-O-methyl)<br>5-CUCCCCAGUCUCUCUUAAATT<br>(SEQ ID NO: 316)<br>TTGAGGGGUCAGAGAGAAUUU-5<br>(SEQ ID NO: 315) | ++ | 51% | 46% |
| 41-3A | Specific modification (2'-O-methyl)<br>5-CUCCCCAGUCUCUCU<u>UA</u>AATT<br>(SEQ ID NO: 317)<br>TTGAGGGGUCAGAGAGA<u>AU</u>UU-5<br>(SEQ ID NO: 318) | ++ | 68% | 15% |
| 41-3B | Specific modification (2'-O-methyl)<br>5-CUCCCCAGUCUCUCU<u>UA</u>AATT<br>(SEQ ID NO: 319)<br>TTGAGGGGUCAGAGAGA<u>AU</u>UU-5<br>(SEQ ID NO: 320) | ++ | 69% | 7% |

TABLE 42

| gene | chimpanzee SOD2(NM_001009022) (SEQ ID NO: 321) SIRNA | Locus Stability | 108-126 BP Expression inhibition ratio | Growth inhibition ratio |
|---|---|---|---|---|
| 42-1 | Unmodified siRNA<br>5-GAAUAACCUGAACGUCACCTT<br>(SEQ ID NO: 322)<br>TTCUUAUUGGACUUGCAGUGG-5<br>(SEQ ID NO: 323) | + | 59% | 0% |
| 42-2 | Random modification (2'-O-methyl)<br>5-GAAUAACCUGAACGUCACCTT<br>(SEQ ID NO: 324)<br>TTCUUAUUGGACUUGCAGUGG-5<br>(SEQ ID NO: 323) | ++ | 17% | 49% |
| 42-3A | Specific modification (2'-O-methyl)<br>5-GAA<u>UA</u>ACCUGAACGUCACCTT<br>(SEQ ID NO: 325)<br>TTCUU<u>AU</u>UGGACUUGCAGUGG-5<br>(SEQ ID NO: 326) | ++ | 51% | 12% |
| 42-3B | Specific modification (2'-O-methyl)<br>5-GAA<u>UA</u>ACCUGAACGUCACCTT<br>(SEQ ID NO: 327)<br>TTCUU<u>AU</u>UGGACUUGCAGUGG-5<br>(SEQ ID NO: 328) | ++ | 55% | 4% |

TABLE 43

| gene | Chimpanzee SOD2(NM_001009022) (SEQ ID NO: 321) SIRNA | Locus Stability | 119-137 BP Expression inhibition ratio | Growth inhibition ratio |
|---|---|---|---|---|
| 43-1 | Unmodified siRNA<br>5-ACGUCACCGAGGAGAAGUATT<br>(SEQ ID NO: 329)<br>TTUGCAGUGGCUCCUCUUCAU-5<br>(SEQ ID NO: 330) | + | 65% | 0% |

TABLE 43-continued

| | | | 119-137 BP | |
|---|---|---|---|---|
| gene | Chimpanzee SOD2(NM_001009022) (SEQ ID NO: 321) SIRNA | Locus Stability | Expression inhibition ratio | Growth inhibition ratio |
| 43-2 | Random modification (2'-O-methyl)<br>5-ACGUCACCGAGGAGAAGUAUTT<br>(SEQ ID NO: 331)<br>TTUGCAGUGGCUCCUCUUCAU-5<br>(SEQ ID NO: 330) | ++ | 36% | 46% |
| 43-3A | Specific modification (2'-O-methyl)<br>5-ACGUCACCGAGGAGAAG<u>UA</u>TT<br>(SEQ ID NO: 332)<br>TTUGCAGUGGCUCCUCUUC<u>AU</u>-5<br>(SEQ ID NO: 333) | ++ | 48% | 8% |
| 43-3B | Specific modification (2'-O-methyl)<br>5-ACGUCACCGAGGAGAAG<u>U</u>ATT<br>(SEQ ID NO: 334)<br>TTUGCAGUGGCUCCUCUUC<u>AU</u>-5<br>(SEQ ID NO: 330) | ++ | 69% | 2% |

TABLE 44

| | | | 131-149 BP | |
|---|---|---|---|---|
| gene | Chimpanzee SOD2(NM_001009022) (SEQ ID NO: 321) SIRNA | Locus Stability | Expression inhibition ratio | Growth inhibition ratio |
| 44-1 | Unmodified siRNA<br>5-AGAAGUACCAGGAGGCGUUTT<br>(SEQ ID NO: 335)<br>TTUCUUCAUGGUCCUCCGCAA-5<br>(SEQ ID NO: 336) | + | 75% | 0% |
| 44-2 | Random modification (2'-O-methyl)<br>5-AGAAGUACCAGGAGGCGUUTT<br>(SEQ ID NO: 337)<br>TTUCUUCAUGGUCCUCCGCAA-5<br>(SEQ ID NO: 336) | ++ | 24% | 39% |
| 44-3A | Specific modification (2'-O-methyl)<br>5-AGAAG<u>UA</u>CCAGGAGGCGUUTT<br>(SEQ ID NO: 338)<br>TTUCUUC<u>AU</u>GGUCCUCCGCAA-5<br>(SEQ ID NO: 339) | ++ | 68% | 9% |
| 44-3B | Specific modification (2'-O-methyl)<br>5-AGAAG<u>UA</u>CCAGGAGGCGUUTT<br>(SEQ ID NO: 340)<br>TTUCUUC<u>AU</u>GGUCCUCCGCAA-5<br>(SEQ ID NO: 341) | ++ | 69% | 3% |

TABLE 45

| | | | 168-186 BP | |
|---|---|---|---|---|
| gene | Chimpanzee SOD2(NM_001009022) (SEQ ID NO: 321) SIRNA | Locus Stability | Expression inhibition ratio | Growth inhibition ratio |
| 45-1 | Unmodified siRNA<br>5-AGCCCAGAUAGCUCUUCAGTT<br>(SEQ ID NO: 342)<br>TTUCGGGUCUAUCGAGAAGUC-5<br>(SEQ ID NO: 343) | + | 72% | 0% |
| 45-2 | Random modification (2'-deoxy-2'-fluoro)<br>5-AGCCCAGAUAGCUCUUCAGTT<br>(SEQ ID NO: 344)<br>TTUCGGGUCUAUCGAGAAGUC-5<br>(SEQ ID NO: 343) | ++ | 35% | 46% |

TABLE 45-continued

| gene | Chimpanzee SOD2(NM_001009022) (SEQ ID NO: 321) SIRNA | Locus Stability | 168-186 BP Expression inhibition ratio | Growth inhibition ratio |
|---|---|---|---|---|
| 45-3A | Specific modification (2'-deoxy-2'-fluoro)<br>5-AGCCCAGAUAGCUCUUCAGTT<br>(SEQ ID NO: 345)<br>TTUCGGGUCUAUCGAGAAGUC-5<br>(SEQ ID NO: 346) | ++ | 61% | 12% |
| 45-3B | Specific modification (2'-deoxy-2'-fluoro)<br>5-AGCCCAGAUAGCUCUUCAGTT<br>(SEQ ID NO: 347)<br>TTUCGGGUCUAUCGAGAAGUC-5<br>(SEQ ID NO: 348) | ++ | 69% | 5% |

TABLE 46

| gene | Chimpanzee SOD2(NM_001009022) (SEQ ID NO: 321) SIRNA | Locus Stability | 240-258 BP Expression inhibition ratio | Growth inhibition ratio |
|---|---|---|---|---|
| 46-1 | Unmodified siRNA<br>5-AAACCUCAGCCCUAACGGUTT<br>(SEQ ID NO: 349)<br>TTUUUGGAGUCGGGAUUGCCA-5<br>(SEQ ID NO: 350) | + | 94% | 0% |
| 46-2 | Random modification (2'-O-methyl)<br>5-AAACCUCAGCCCUAACGGUTT<br>(SEQ ID NO: 351)<br>TTUUUGGAGUCGGGAUUGCCA-5<br>(SEQ ID NO: 350) | ++ | 51% | 62% |
| 46-3A | Specific modification (2'-O-methyl)<br>5-AAACCUCAGCCCUAACGGUTT<br>(SEQ ID NO: 352)<br>TTUUUGGAGU CGGGAUUGCCA-5<br>(SEQ ID NO: 353) | ++ | 79% | 10% |
| 46-3B | Specific modification (2'-O-methyl)<br>5-AAACCUCAGCCCUAACGGUTT<br>(SEQ ID NO: 354)<br>TTUUUGGAGUCGGGAUUGCCA-5<br>(SEQ ID NO: 355) | ++ | 69% | 6% |

TABLE 47

| gene | Chimpanzee SOD2(NM_001009022) (SEQ ID NO: 321) SIRNA | Locus Stability | 323-341 BP Expression inhibition ratio | Growth inhibition ratio |
|---|---|---|---|---|
| 47-1 | Unmodified siRNA<br>5-UUAAGGAGAAGCUGACGGCTT<br>(SEQ ID NO: 356)<br>TTAAUUCCUCUUCGACUGCCG-5<br>(SEQ ID NO: 357) | + | 73% | 0% |
| 47-2 | Random modification (2'-O-methyl)<br>5-UUAAGGAGAAGCUGACGGCTT<br>(SEQ ID NO: 358)<br>TTAAUUCCUCUUCGACUGCCG-5<br>(SEQ ID NO: 357) | ++ | 24% | 35% |
| 47-3A | Specific modification (2'-O-methyl)<br>5-UUAAGGAGAAGCUGACGGCTT<br>(SEQ ID NO: 359)<br>TTAAUUCCUCUUCGACUGCCG-5<br>(SEQ ID NO: 360) | ++ | 67% | 12% |

TABLE 47-continued

| gene | Chimpanzee SOD2(NM_001009022) (SEQ ID NO: 321) SIRNA | Locus Stability | 323-341 BP | |
|---|---|---|---|---|
| | | | Expression inhibition ratio | Growth inhibition ratio |
| 47-3B | Specific modification (2'-O-methyl)<br>5-UUAAGGAGAAGCUGACGGCTT<br>(SEQ ID NO: 361)<br>TTAAUUCCUCUUCGACUGCCG-5<br>(SEQ ID NO: 362) | ++ | 69% | 3% |

TABLE 48

| gene | Chimpanzee SOD2(NM_001009022) (SEQ ID NO: 321) SIRNA | Locus Stability | 391-409 BP | |
|---|---|---|---|---|
| | | | Expression inhibition ratio | Growth inhibition ratio |
| 48-1 | Unmodified siRNA<br>5-AAGGAACGGGGACACUUACTT<br>(SEQ ID NO: 363)<br>TTUUCCUUGCCCCUGUGAAUG-5<br>(SEQ ID NO: 364) | + | 44% | 0% |
| 48-2 | Random modification (2'-O-methyl)<br>5-AAGGAACGGGGACACUUACTT<br>(SEQ ID NO: 365)<br>TTUUCCUUGCCCCUGUGAAUG-5<br>(SEQ ID NO: 364) | ++ | 12% | 46% |
| 48-3A | Specific modification (2'-O-methyl)<br>5-AAGGAACGGGGACACUUACTT<br>(SEQ ID NO: 366)<br>TTUUCCUUGCCCCUGUGAAUG-5<br>(SEQ ID NO: 367) | ++ | 35% | 15% |
| 48-3B | Specific modification (2'-O-methyl)<br>5-AAGGAACGGGGACACUUACTT<br>(SEQ ID NO: 363)<br>TTUUCCUUGCCCCUGUGAAUG-5<br>(SEQ ID NO: 368) | ++ | 38% | 6% |

TABLE 49

| gene | Chimpanzee SOD2(NM_001009022) (SEQ ID NO: 321) SIRNA | Locus Stability | 486-504 BP | |
|---|---|---|---|---|
| | | | Expression inhibition ratio | Growth inhibition ratio |
| 49-1 | Unmodified siRNA<br>5-GGAGCACGCUUACUACCUUTT<br>(SEQ ID NO: 369)<br>TTCCUCGUGCGAAUGAUGGAA-5<br>(SEQ ID NO: 370) | + | 77% | 0% |
| 49-2 | Random modification (2'-O-methyl)<br>5-GGAGCACGCUUACUACCUUTT<br>(SEQ ID NO: 371)<br>TTCCUCGUGCGAAUGAUGGAA-5<br>(SEQ ID NO: 370) | ++ | 51% | 38% |
| 49-3A | Specific modification (2'-O-methyl)<br>5-GGAGCACGCUUACUACCUUTT<br>(SEQ ID NO: 372)<br>TTCCUCGUGCGAAUGAUGGAA-5<br>(SEQ ID NO: 373) | ++ | 68% | 13% |
| 49-3B | Specific modification (2'-O-methyl)<br>5-GGAGCACGCUUACUACCUUTT<br>(SEQ ID NO: 374)<br>TTCCUCGUGCGAAUGAUGGAA-5<br>(SEQ ID NO: 375) | ++ | 69% | 7% |

TABLE 50

| gene | Rhesus monkey RECEPTOR(XM_001111972)<br>(SEQ ID NO: 383)<br>SIRNA | Locus<br>Stability | 168-186 BP<br>Expression<br>inhibition ratio | Growth<br>inhibition ratio |
|---|---|---|---|---|
| 50-1 | Unmodified siRNA<br>5-GGCGGGCUCUUUCCUAUUCTT<br>(SEQ ID NO: 376)<br>TTCCGCCCGAGAAAGGAUAAG-5<br>(SEQ ID NO: 377) | + | 77% | 0% |
| 50-2 | Random modification (2'-O-methyl)<br>5-GGCGGGCUCUUUCCUAUUCTT<br>(SEQ ID NO: 378)<br>TTCCGCCCGAGAAAGGAUAAG-5<br>(SEQ ID NO: 377) | ++ | 51% | 43% |
| 50-3A | Specific modification (2'-O-methyl)<br>5-GGCGGGCUCUUUCCUAUUCTT<br>(SEQ ID NO: 379)<br>TTCCGCCCGAGAAAGGAUAAG-5<br>(SEQ ID NO: 380) | ++ | 68% | 8% |
| 50-3B | Specific modification (2'-O-methyl)<br>5-GGCGGGCUCUUUCCUAUUCTT<br>(SEQ ID NO: 381)<br>TTCCGCCCGAGAAAGGAUAAG-5<br>(SEQ ID NO: 382) | ++ | 69% | 5% |

TABLE 51

| gene | Rhesus monkey RECEPTOR(XM_001111972)<br>(SEQ ID NO: 383)<br>SIRNA | Locus<br>Stability | 2006-2024 BP<br>Expression<br>inhibition ratio | Growth<br>inhibition ratio |
|---|---|---|---|---|
| 51-1 | Unmodified siRNA<br>5-CCGAGAGCUCUCCUACCUUTT<br>(SEQ ID NO: 384)<br>TTGGCUCUCGAGAGGAUGGAA-5<br>(SEQ ID NO: 385) | + | 80% | 0% |
| 51-2 | Random modification (2'-O-methyl)<br>5-CCGAGAGCUCUCCUACCUUTT<br>(SEQ ID NO: 386)<br>TTGGCUCUCGAGAGGAUGGAA-5<br>(SEQ ID NO: 385) | ++ | 34% | 43% |
| 51-3A | Specific modification (2'-O-methyl)<br>5-CCGAGAGCUCUCCUACCUUTT<br>(SEQ ID NO: 387)<br>TTGGCUCUCGAGAGGAUGGAA-5<br>(SEQ ID NO: 388) | ++ | 72% | 12% |
| 51-3B | Specific modification (2'-O-methyl)<br>5-CCGAGAGCUCUCCUACCUUTT<br>(SEQ ID NO: 389)<br>TTGGCUCUCGAGAGGAUGGAA-5<br>(SEQ ID NO: 390) | ++ | 75% | 5% |

TABLE 52

| gene | Rhesus monkey RECEPTOR(XM_001111972)<br>(SEQ ID NO: 383)<br>SIRNA | Locus<br>Stability | 2013-2031 BP<br>Expression<br>inhibition ratio | Growth<br>inhibition ratio |
|---|---|---|---|---|
| 52-1 | Unmodified siRNA<br>5-CUCUCCUACCUUCUCCCUCTT<br>(SEQ ID NO: 391)<br>TTGAGAGGAUGGAAGAGGGAGA-5<br>(SEQ ID NO: 392) | + | 83% | 0% |

TABLE 52-continued

| gene | Rhesus monkey RECEPTOR(XM_001111972)<br>(SEQ ID NO: 383)<br>SIRNA | Locus<br>Stability | 2013-2031 BP |  |
|---|---|---|---|---|
| | | | Expression<br>inhibition ratio | Growth<br>inhibition ratio |
| 52-2 | Random modification (2'-deoxy-2'-fluoro)<br>5-CUCUCCUACCUUCUCCUCUTT<br>(SEQ ID NO: 393)<br>TTGAGAGGAUGGAAGAGGAGA-5<br>(SEQ ID NO: 392) | ++ | 69% | 37% |
| 52-3A | Specific modification (2'-deoxy-2'-fluoro)<br>5-CUCUCCUACCUUCUCCUCUTT<br>(SEQ ID NO: 394)<br>TTGAGAGGAUGGAAGAGGAGA-5<br>(SEQ ID NO: 395) | ++ | 73% | 6% |
| 52-3B | Specific modification (2'-deoxy-2'-fluoro)<br>5-CUCUCCUACCUUCUCCUCUTT<br>(SEQ ID NO: 396)<br>TTGAGAGGAUGGAAGAGGAGA-5<br>(SEQ ID NO: 395) | ++ | 78% | 1% |

TABLE 53

| gene | Rhesus monkey RECEPTOR(XM_001111972)<br>(SEQ ID NO: 383)<br>SIRNA | Locus<br>Stability | 2018-2036 BP |  |
|---|---|---|---|---|
| | | | Expression<br>inhibition ratio | Growth<br>inhibition ratio |
| 53-1 | Unmodified siRNA<br>5-CUACCUUCUCCUCUUCUCCTT<br>(SEQ ID NO: 397)<br>TTGAUGGAAGAGGAGAAGAGG-5<br>(SEQ ID NO: 398) | + | 75% | 0% |
| 53-2 | Random modification (2'-O-methyl)<br>5-CUACCUUCUCCUCUUCUCCTT<br>(SEQ ID NO: 399)<br>TTGAUGGAAGAGGAGAAGAGG-5<br>(SEQ ID NO: 398) | ++ | 27% | 38% |
| 53-3A | Specific modification (2'-O-methyl)<br>5-CUACCUUCUCCUCUUCUCCTT<br>(SEQ ID NO: 400)<br>TTGAUGGAAGAGGAGAAGAGG-5<br>(SEQ ID NO: 401) | ++ | 68% | 5% |
| 53-3B | Specific modification (2'-O-methyl)<br>5-CUACCUUCUCCUCUUCUCCTT<br>(SEQ ID NO: 402)<br>TTGAUGGAAGAGGAGAAGAGG-5<br>(SEQ ID NO: 403) | ++ | 69% | 2% |

TABLE 54

| gene | Rhesus monkey RECEPTOR(XM_001111972)<br>(SEQ ID NO: 383)<br>SIRNA | Locus<br>Stability | 13-31 BP |  |
|---|---|---|---|---|
| | | | Expression<br>inhibition ratio | Growth<br>inhibition ratio |
| 54-1 | Unmodified siRNA<br>5-AGCCUCCAAACUCCUAGCUTT<br>(SEQ ID NO: 404)<br>TTUCGGAGGUUUGAGGAUCGA-5<br>(SEQ ID NO: 405) | + | 43% | 0% |
| 54-2 | Random modification (2'-deoxy-2'-fluoro)<br>5-AGCCUCCAAACUCCUAGCUTT<br>(SEQ ID NO: 406)<br>TTUCGGAGGUUUGAGGAUCGA-5<br>(SEQ ID NO: 405) | ++ | 16% | 34% |

TABLE 54-continued

| gene | Rhesus monkey RECEPTOR(XM_001111972)<br>(SEQ ID NO: 383)<br>SIRNA | Locus<br>Stability | 13-31 BP<br>Expression<br>inhibition ratio | Growth<br>inhibition ratio |
|---|---|---|---|---|
| 54-3A | Specific modification (2'-deoxy-2'-fluoro)<br>5-AGCCUCCAAACUCCUAGCUTT<br>(SEQ ID NO: 407)<br>TTUCGGAGGUUUGAGGAUCGA-5<br>(SEQ ID NO: 408) | ++ | 32% | 9% |
| 54-3B | Specific modification (2'-deoxy-2'-fluoro)<br>5-AGCCUCCAAACUCCUAGCUTT<br>(SEQ ID NO: 409)<br>TTUCGGAGGUUUGAGGAUCGA-5<br>(SEQ ID NO: 410) | ++ | 69% | 3% |

TABLE 55

| gene | Rhesus monkey RECEPTOR(XM_001111972)<br>(SEQ ID NO: 383)<br>SIRNA | Locus<br>Stability | 24-42 BP<br>Expression<br>inhibition ratio | Growth<br>inhibition ratio |
|---|---|---|---|---|
| 55-1 | Unmodified siRNA<br>5-UCCUAGCUGUCUUGUCCCUTT<br>(SEQ ID NO: 411)<br>TTAGGAUCGACAGAACAGGGA-5<br>(SEQ ID NO: 412) | + | 75% | 0% |
| 55-2 | Random modification (2'-O-methyl)<br>5-UCCUAGCUGUCUUGUCCCUTT<br>(SEQ ID NO: 413)<br>TTAGGAUCGACAGAACAGGGA-5<br>(SEQ ID NO: 412) | ++ | 27% | 33% |
| 55-3A | Specific modification (2'-O-methyl)<br>5-UCCUAGCUGUCUUGUCCCUTT<br>(SEQ ID NO: 414)<br>TTAGGAUCGACAGAACAGGGA-5<br>(SEQ ID NO: 415) | ++ | 68% | 8% |
| 55-3B | Specific modification (2'-O-methyl)<br>5-UCCUAGCUGUCUUGUCCCUTT<br>(SEQ ID NO: 416)<br>TTAGGAUCGACAGAACAGGGA-5<br>(SEQ ID NO: 417) | ++ | 71% | 1% |

TABLE 56

| gene | Rhesus monkey RECEPTOR(XM_001111972)<br>(SEQ ID NO: 383)<br>SIRNA | Locus<br>Stability | 162-180 BP<br>Expression<br>inhibition ratio | Growth<br>inhibition ratio |
|---|---|---|---|---|
| 56-1 | Unmodified siRNA<br>5-AUACUUGGCGGGCUCUUUCTT<br>(SEQ ID NO: 418)<br>TTUAUGAACCGCCCGAGAAAG-5<br>(SEQ ID NO: 419) | + | 53% | 0% |
| 56-2 | Random modification (2'-O-methyl)<br>5-AUACUUGGCGGGCUCUUUCTT<br>(SEQ ID NO: 420)<br>TTUAUGAACCGCCCGAGAAAG-5<br>(SEQ ID NO: 419) | ++ | 19% | 35% |
| 56-3A | Specific modification (2'-O-methyl)<br>5-AUACUUGGCGGGCUCUUUCTT<br>(SEQ ID NO: 421)<br>TTUAUGAACCGCCCGAGAAAG-5<br>(SEQ ID NO: 422) | ++ | 42% | 6% |

TABLE 56-continued

| gene | Rhesus monkey RECEPTOR(XM_001111972) (SEQ ID NO: 383) SIRNA | Locus Stability | 162-180 BP Expression inhibition ratio | Growth inhibition ratio |
|---|---|---|---|---|
| 56-3B | Specific modification (2'-O-methyl)<br>5-A<u>UA</u>CUUGGCGGGCUCUUUCTT<br>(SEQ ID NO: 423)<br>TTU<u>AU</u>GAACCGCCCGAGAAAG-5<br>(SEQ ID NO: 424) | ++ | 48% | 1% |

TABLE 57

| gene | Rhesus monkey RECEPTOR(XM_001111972) (SEQ ID NO: 383) SIRNA | Locus Stability | 536-554 BP Expression inhibition ratio | Growth inhibition ratio |
|---|---|---|---|---|
| 57-1 | Unmodified siRNA<br>5-GGGGCUCUUCUACAUUCCCTT<br>(SEQ ID NO: 424)<br>TTCCCCGAGAAGAUGUAAGGG-5<br>(SEQ ID NO: 425) | + | 77% | 0% |
| 57-2 | Random modification (2'-O-methyl)<br>5-GGGGCUCUUCUACAUUCCCTT<br>(SEQ ID NO: 426)<br>TTCCCCGAGAAGAUGUAAGGG-5<br>(SEQ ID NO: 425) | ++ | 51% | 34% |
| 57-3A | Specific modification (2'-O-methyl)<br>5-GGGGCUCUUC<u>UA</u>CAUUCCCTT<br>(SEQ ID NO: 427)<br>TTCCCCGAGAAG<u>AUG</u>UAAGGG-5<br>(SEQ ID NO: 428) | ++ | 68% | 5% |
| 57-3B | Specific modification (2'-O-methyl)<br>5-GGGGCUCUUC<u>UA</u>CAUUCCCTT<br>(SEQ ID NO: 429)<br>TTCCCCGAGAAG<u>AUG</u>UAAGGG-5<br>(SEQ ID NO: 430) | ++ | 72% | 2% |

TABLE 58

| gene | Rhesus monkey RECEPTOR(XM_001111972) (SEQ ID NO: 383) SIRNA | Locus Stability | 669-687 BP Expression inhibition ratio | Growth inhibition ratio |
|---|---|---|---|---|
| 58-1 | Unmodified siRNA<br>5-GAGUAUUUCCGCUGGAACUTT<br>(SEQ ID NO: 431)<br>TTCUCAUAAAGGCGACCUUGA-5<br>(SEQ ID NO: 432) | + | 87% | 0% |
| 58-2 | Random modification (2'-deoxy-2'-fluoro)<br>5-GAGUAUUUCCGCUGGAACUTT<br>(SEQ ID NO: 433)<br>TTCUCAUAAAGGCGACCUUGA-5<br>(SEQ ID NO: 432) | ++ | 21% | 37% |
| 58-3A | Specific modification (2'-deoxy-2'-fluoro)<br>5-GAG<u>UA</u>UUUCCGC<u>UG</u>GAACUTT<br>(SEQ ID NO: 434)<br>TTCUC<u>AU</u>AAAGGCGA<u>CC</u>UUGA-5<br>(SEQ ID NO: 435) | ++ | 73% | 6% |
| 58-3B | Specific modification (2'-deoxy-2'-fluoro)<br>5-GAG<u>UA</u>UUUCCGCUGGAACUTT<br>(SEQ ID NO: 436)<br>TTCUC<u>AU</u>AAAGGCGACCUUGA-5<br>(SEQ ID NO: 437) | ++ | 75% | 1% |

TABLE 59

| gene | Rhesus monkey RECEPTOR(XM_001111972)<br>(SEQ ID NO: 383)<br>SIRNA | Locus<br>Stability | 753-771 BP<br>Expression<br>inhibition ratio | Growth<br>inhibition ratio |
|---|---|---|---|---|
| 59-1 | Unmodified siRNA<br>5-GCUGAGGAAAGGGACAUCUTT<br>(SEQ ID NO: 438)<br>TTCGACUCCUUUCCCUGUAGA-5<br>(SEQ ID NO: 439) | + | 85% | 0% |
| 59-2 | Random modification (2'-O-methyl)<br>5-GCUGAGGAAAGGGACAUCUTT<br>(SEQ ID NO: 440)<br>TTCGACUCCUUUCCCUGUAGA-5<br>(SEQ ID NO: 439) | ++ | 61% | 31% |
| 59-3A | Specific modification (2'-O-methyl)<br>5-GCUGAGGAAAGGGACAUCUTT<br>(SEQ ID NO: 441)<br>TTCGACUCCUUUCCCUGUAGA-5<br>(SEQ ID NO: 442) | ++ | 76% | 7% |
| 59-3B | Specific modification (2'-O-methyl)<br>5-GCUGAGGAAAGGGACAUCUTT<br>(SEQ ID NO: 441)<br>TTCGACUCCUUUCCCUGUAGA-5<br>(SEQ ID NO: 443) | ++ | 78% | 3% |

TABLE 60

| gene | Rhesus monkey RECEPTOR(XM_001111972)<br>(SEQ ID NO: 383)<br>SIRNA | Locus<br>Stability | 800-818 BP<br>Expression<br>inhibition ratio | Growth<br>inhibition ratio |
|---|---|---|---|---|
| 60-1 | Unmodified siRNA<br>5-GUACUCUGAUGAGGAAGAGTT<br>(SEQ ID NO: 444)<br>TTCAUGAGACUACUCCUUCUC-5<br>(SEQ ID NO: 445) | + | 75% | 0% |
| 60-2 | Random modification (2'-O-methyl)<br>5-GUACUCUGAUGAGGAAGAGTT<br>(SEQ ID NO: 446)<br>TTCAUGAGACUACUCCUUCUC-5<br>(SEQ ID NO: 445) | ++ | 18% | 37% |
| 60-3A | Specific modification (2'-O-methyl)<br>5-GUACUCUGAUGAGGAAGAGTT<br>(SEQ ID NO: 447)<br>TTCAUGAGACUACUCCUUCUC-5<br>(SEQ ID NO: 448) | ++ | 68% | 8% |
| 60-3B | Specific modification (2'-O-methyl)<br>5-GUACUCUGAUGAGGAAGAGTT<br>(SEQ ID NO: 449)<br>TTCAUGAGACUACUCCUUCUC-5<br>(SEQ ID NO: 448) | ++ | 69% | 1% |

TABLE 61

| gene | Rhesus monkey RECEPTOR(XM_001111972)<br>(SEQ ID NO: 383)<br>SIRNA | Locus<br>Stability | 854-872 BP<br>Expression<br>inhibition ratio | Growth<br>inhibition ratio |
|---|---|---|---|---|
| 61-1 | Unmodified siRNA<br>5-GGCCAAAGUAAUCGUGGUUTT<br>(SEQ ID NO: 450)<br>TTCCGGUUUCAUUAGCACCAA-5<br>(SEQ ID NO: 451) | + | 93% | 0% |

TABLE 61-continued

| gene | Rhesus monkey RECEPTOR (XM_001111972)<br>(SEQ ID NO: 383)<br>SIRNA | Locus<br>Stability | 854-872 BP<br>Expression<br>inhibition ratio | Growth<br>inhibition ratio |
|---|---|---|---|---|
| 61-2 | Random modification (2'-O-methyl)<br>5-GGCCAAAGUAAUCGUGGUUTT<br>(SEQ ID NO: 452)<br>TTCCGGUUUCAUUAGCACCAA-5<br>(SEQ ID NO: 451) | ++ | 37% | 31% |
| 61-3A | Specific modification (2'-O-methyl)<br>5-GGCCAAAG<u>UA</u>AUCG<u>U</u>GGUUTT<br>(SEQ ID NO: 453)<br>TTCCGGUUUC<u>AU</u>UAGCACCAA-5<br>(SEQ ID NO: 454) | ++ | 86% | 10% |
| 61-3B | Specific modification (2'-O-methyl)<br>5-GGCCAAAG<u>U</u>AAUCGUGGUUTT<br>(SEQ ID NO: 455)<br>TTCCGGUUUC<u>A</u>UUAGCACCAA-5<br>(SEQ ID NO: 456) | ++ | 85% | 5% |

TABLE 62

| gene | Rhesus monkey RECEPTOR (XM_001111972)<br>(SEQ ID NO: 383)<br>SIRNA | Locus<br>Stability | 1602-1620 BP<br>Expression<br>inhibition ratio | Growth<br>inhibition ratio |
|---|---|---|---|---|
| 62-1 | Unmodified siRNA<br>5-GUCUAUGCCAAGAAGGGAGTT<br>(SEQ ID NO: 457)<br>TTCAGAUACGGUUCUUCCCUC-5<br>(SEQ ID NO: 458) | + | 81% | 0% |
| 62-2 | Random modification (2'-O-methyl)<br>5-GUCUAUGCCAAGAAGGGAGTT<br>(SEQ ID NO: 459)<br>TTCAGAUACGGUUCUUCCCUC-5<br>(SEQ ID NO: 458) | ++ | 24% | 31% |
| 62-3A | Specific modification (2'-O-methyl)<br>5-GUC<u>UA</u>UGCCAAGAAGGGAGTT<br>(SEQ ID NO: 460)<br>TTCAG<u>AU</u>ACGGUUCUUCCCUC-5<br>(SEQ ID NO: 461) | ++ | 72% | 7% |
| 62-3B | Specific modification (2'-O-methyl)<br>5-GUC<u>U</u>AUGCCAAGAAGGGAGTT<br>(SEQ ID NO: 462)<br>TTCAG<u>A</u>UACGGUUCUUCCCUC-5<br>(SEQ ID NO: 463) | ++ | 76% | 2% |

TABLE 63

| gene | Rhesus monkey<br>RECEPTOR (XM_001111972)<br>(SEQ ID NO: 383)<br>SIRNA | Locus<br>Stability | 2293-2311 BP<br>Expression<br>inhibition ratio | Growth<br>inhibition ratio |
|---|---|---|---|---|
| 63-1 | Unmodified siRNA<br>5-UCUACACCGCGCCCCCUCTT<br>(SEQ ID NO: 464)<br>TTAGAUGUGGCGCGGGGGAG-5<br>(SEQ ID NO: 465) | + | 84% | 0% |
| 63-2 | Random modification (2'-O-methyl)<br>5-UCUACACCGCGCCCCCUCTT<br>(SEQ ID NO: 466)<br>TTAGAUGUGGCGCGGGGGAG-5<br>(SEQ ID NO: 465) | ++ | 39% | 33% |

TABLE 63-continued

| gene | Rhesus monkey RECEPTOR(XM_001111972) (SEQ ID NO: 383) SIRNA | Locus Stability | 2293-2311 BP Expression inhibition ratio | Growth inhibition ratio |
|---|---|---|---|---|
| 63-3A | Specific modification (2'-O-methyl)<br>5-UCUACACCGCGCCCCCCUCTT<br>(SEQ ID NO: 467)<br>TTAGAUGTGGCGCGGGGGGAG-5<br>(SEQ ID NO: 468) | ++ | 73% | 6% |
| 63-3B | Specific modification (2'-O-methyl)<br>5-UCUACACCGCGCCCCCUCTT<br>(SEQ ID NO: 469)<br>TTAGAUGTGGCGCGGGGGGAG-5<br>(SEQ ID NO: 470) | ++ | 79% | 3% |

TABLE 64

| gene | Rhesus monkey RECEPTOR(XM_001111972) (SEQ ID NO: 383) SIRNA | Locus Stability | 2302-2320 BP Expression inhibition ratio | Growth inhibition ratio |
|---|---|---|---|---|
| 64-1 | Unmodified siRNA<br>5-CGCCCCCCUCAAGCUACCGTT<br>(SEQ ID NO: 471)<br>TTGCGGGGGGAGUUCGAUGGC-5<br>(SEQ ID NO: 472) | + | 81% | 0% |
| 64-2 | Random modification (2'-O-methyl)<br>5-CGCCCCCCUCAAGCUACCGTT<br>(SEQ ID NO: 473)<br>TTGCGGGGGGAGUUCGAUGGC-5<br>(SEQ ID NO: 472) | ++ | 44% | 48% |
| 64-3A | Specific modification (2'-O-methyl)<br>5-CGCCCCCCUCAAGCUACCGTT<br>(SEQ ID NO: 474)<br>TTGCGGGGGGAGUUCGAUGGC-5<br>(SEQ ID NO: 475) | ++ | 72% | 9% |
| 64-3B | Specific modification (2'-O-methyl)<br>5-CGCCCCCCUCAAGCUACCGTT<br>(SEQ ID NO: 476)<br>TTGCGGGGGGAGUUCGAUGGC-5<br>(SEQ ID NO: 477) | ++ | 76% | 3% |

TABLE 65

| gene | Rhesus monkey RECEPTOR(XM_001111972) (SEQ ID NO: 383) SIRNA | Locus Stability | 2314-2332 BP Expression inhibition ratio | Growth inhibition ratio |
|---|---|---|---|---|
| 65-1 | Unmodified siRNA<br>5-GCUACCGCAACCACGAGCUTT<br>(SEQ ID NO: 478)<br>TTCGAUGGCGUUGGUGCUCGA-5<br>(SEQ ID NO: 479) | + | 47% | 0% |
| 65-2 | Random modification (2'-deoxy-2'-fluoro)<br>5-GCUACCGCAACCACGAGCUTT<br>(SEQ ID NO: 480)<br>TTCGAUGGCGUUGGUGCUCGA-5<br>(SEQ ID NO: 479) | ++ | 21% | 37% |

TABLE 65-continued

| | Rhesus monkey RECEPTOR(XM_001111972) | | 2314-2332 BP | |
|---|---|---|---|---|
| gene | (SEQ ID NO: 383) SIRNA | Locus Stability | Expression inhibition ratio | Growth inhibition ratio |
| 65-3A | Specific modification (2'-deoxy-2'-fluoro) 5-GC<u>U</u>ACCGC<u>AACC</u>ACGAGC<u>U</u>TT (SEQ ID NO: 481) TTCG<u>AU</u>GGCG<u>UU</u>GG<u>U</u>GCUCGA-5 (SEQ ID NO: 482) | ++ | 42% | 7% |
| 65-3B | Specific modification (2'-deoxy-2'-fluoro) 5-GC<u>U</u>ACCGCAACCACGAGC<u>U</u>TT (SEQ ID NO: 483) TTCG<u>AU</u>GGCGUUGGUGCUCGA-5 (SEQ ID NO: 484) | ++ | 45% | 3% |

TABLE 66

| | Rhesus monkey RECEPTOR(XM_001111972) | | 2522-2540 BP | |
|---|---|---|---|---|
| gene | (SEQ ID NO: 383) SIRNA | Locus Stability | Expression inhibition ratio | Growth inhibition ratio |
| 66-1 | Unmodified siRNA 5-CUCCUUCAUUCCAGCCUAUTT (SEQ ID NO: 485) TTGAGGAAGUAAGGUCGGAUA-5 (SEQ ID NO: 486) | + | 84% | 0% |
| 66-2 | Random modification (2'-O-methyl) 5-CUCCUUCAUUCCAGCCUAUTT (SEQ ID NO: 487) TTGAGGAAGUAAGGUCGGAUA-5 (SEQ ID NO: 486) | ++ | 51% | 31% |
| 66-3A | Specific modification (2'-O-methyl) 5-CUCC<u>UU</u>CAUUCCAGCC<u>U</u>AUTT (SEQ ID NO: 488) TTGAGGAAG<u>U</u>AAGG<u>U</u>CGG<u>AU</u>A-5 (SEQ ID NO: 489) | ++ | 78% | 8% |
| 66-3B | Specific modification (2'-O-methyl) 5-CUCCUUCAUUCCAGCC<u>U</u>AUTT (SEQ ID NO: 490) TTGAGGAAGUAAGGUCGG<u>AU</u>A-5 (SEQ ID NO: 491) | ++ | 81% | 4% |

TABLE 67

| | Rhesus monkey RECEPTOR(XM_001111972) | | 2998-3016 BP | |
|---|---|---|---|---|
| gene | (SEQ ID NO: 383) SIRNA | Locus Stability | Expression inhibition ratio | Growth inhibition ratio |
| 67-1 | Unmodified siRNA 5-AGAAAAGCAGCGAUACGCUTT (SEQ ID NO: 492) TTUCUUUUCGUCGCUAUGCGA-5 (SEQ ID NO: 493) | + | 78% | 0% |
| 67-2 | Random modification (2'-O-methyl) 5-AGAAAAGCAGCGAUACGCUTT (SEQ ID NO: 494) TTUCUUUUCGUCGCUAUGCGA-5 (SEQ ID NO: 493) | ++ | 34% | 37% |

TABLE 67-continued

| gene | Rhesus monkey RECEPTOR(XM_001111972) (SEQ ID NO: 383) SIRNA | Locus Stability | 2998-3016 BP Expression inhibition ratio | Growth inhibition ratio |
|---|---|---|---|---|
| 67-3A | Specific modification (2'-O-methyl) 5-AGAAAAGCAGCGAUACGCUTT (SEQ ID NO: 495) TTUCUUUUCGUCGCUAUGCGA-5 (SEQ ID NO: 496) | ++ | 68% | 8% |
| 67-3B | Specific modification (2'-O-methyl) 5-AGAAAAGCAGCGAUACGCUTT (SEQ ID NO: 497) TTUCUUUUCGUCGCUAUGCGA-5 (SEQ ID NO: 493) | ++ | 69% | 1% |

TABLE 68

| gene | Dog B cell lymphoma(NM_001003016) (SEQ ID NO: 498) SIRNA | Locus Stability | 480-498 BP Expression inhibition ratio | Growth inhibition ratio |
|---|---|---|---|---|
| 68-1 | Unmodified siRNA 5-GGAGCUAGACGGGUACGAGTT (SEQ ID NO: 499) TTCCUCGAUCUGCCCAUGCUC-5 (SEQ ID NO: 500) | + | 93% | 0% |
| 68-2 | Random modification (2'-O-methyl) 5-GGAGCUAGACGGGUACGAGTT (SEQ ID NO: 501) TTCCUCGAUCUGCCCAUGCUC-5 (SEQ ID NO: 500) | ++ | 75% | 51% |
| 68-3A | Specific modification (2'-O-methyl) 5-GGAGCUAGACGGGUACGAGTT (SEQ ID NO: 502) TTCCUCGAUCUGCCCAUGCUC-5 (SEQ ID NO: 503) | ++ | 82% | 9% |
| 68-3B | Specific modification (2'-O-methyl) 5-GGAGCUAGACGGGUACGAGTT (SEQ ID NO: 504) TTCCUCGAUCUGCCCAUGCUC-5 (SEQ ID NO: 505) | ++ | 81% | 10% |

TABLE 69

| gene | dog B cell lymphoma(NM_001003016) (SEQ ID NO: 498) SIRNA | Locus Stability | 489-507 BP Expression inhibition ratio | Growth inhibition ratio |
|---|---|---|---|---|
| 69-1 | Unmodified siRNA 5-CGGGUACGAGCCGGAACCUTT (SEQ ID NO: 506) TTGCCCAUGCUCGGCCUUGGA-5 (SEQ ID NO: 507) | ++ | 70% | 0% |
| 69-2 | Random modification (2'-deoxy-2'-fluoro) 5-CGGGUACGAGCCGGAACCUTT (SEQ ID NO: 508) TTGCCCAUGCUCGGCCUUGGA-5 (SEQ ID NO: 507) | +++ | 61% | 43% |

TABLE 69-continued

| | dog B cell lymphoma(NM_001003016) | | 489-507 BP | |
|---|---|---|---|---|
| gene | (SEQ ID NO: 498) SIRNA | Locus Stability | Expression inhibition ratio | Growth inhibition ratio |
| 69-3A | Specific modification (2'-deoxy-2'-fluoro)<br>5-CGGGUACGAGCCGGAACCUTT<br>(SEQ ID NO: 509)<br>TTGCCCAUGCUCGGCCUUGGA-5<br>(SEQ ID NO: 510) | +++ | 68% | 8% |
| 69-3B | Specific modification (2'-deoxy-2'-fluoro)<br>5-CGGGUACGAGCCGGAACCUTT<br>(SEQ ID NO: 509)<br>TTGCCCAUGCUCGGCCUUGGA-5<br>(SEQ ID NO: 511) | +++ | 69% | 1% |

TABLE 70

| | dog B cell lymphoma(NM_001003016) | | 578-596 BP | |
|---|---|---|---|---|
| gene | (SEQ ID NO: 498) SIRNA | Locus Stability | Expression inhibition ratio | Growth inhibition ratio |
| 70-1 | Unmodified siRNA<br>5-ACGGCUCGCUACCCUCGACTT<br>(SEQ ID NO: 512)<br>TTUGCCGAGCGAUGGGAGCUG-5<br>(SEQ ID NO: 513) | + | 87% | 0% |
| 70-2 | Random modification (2'-deoxy-2'-fluoro)<br>5-ACGGCUCGCUACCCUCGACTT<br>(SEQ ID NO: 514)<br>TTUGCCGAGCGAUGGGAGCUG-5<br>(SEQ ID NO: 513) | +++ | 72% | 37% |
| 70-3A | Specific modification (2'-deoxy-2'-fluoro)<br>5-ACGGCUCGCUACCCUCGACTT<br>(SEQ ID NO: 515)<br>TTUGCCGAGCGAUGGGAGCUG-5<br>(SEQ ID NO: 516) | +++ | 78% | 4% |
| 70-3B | Specific modification (2'-deoxy-2'-fluoro)<br>5-ACGGCUCGCUACCCUCGACTT<br>(SEQ ID NO: 517)<br>TTUGCCGAGCGAUGGGAGCUG-5<br>(SEQ ID NO: 516) | +++ | 83% | 1% |

TABLE 71

| | dog B cell lymphoma(NM_001003016) | | 1071-1089 BP | |
|---|---|---|---|---|
| gene | (SEQ ID NO: 498) SIRNA | Locus Stability | Expression inhibition ratio | Growth inhibition ratio |
| 71-1 | Unmodified siRNA<br>5-AGAGGACCUAGAAGGCGGCTT<br>(SEQ ID NO: 518)<br>TTUCUCCUGGAUCUUCCGCCG-5<br>(SEQ ID NO: 519) | + | 97% | 0% |
| 71-2 | Random modification (2'-O-methyl)<br>5-AGAGGACCUAGAAGGCGGCTT<br>(SEQ ID NO: 520)<br>TTUCUCCUGGAUCUUCCGCCG-5<br>(SEQ ID NO: 521) | ++ | 72% | 34% |
| 71-3A | Specific modification (2'-O-methyl)<br>5-AGAGGACCUAGAAGGCGGCTT<br>(SEQ ID NO: 522)<br>TTUCUCCUGGAUCUUCCGCCG-5<br>(SEQ ID NO: 523) | ++ | 89% | 4% |

TABLE 71-continued

| | dog B cell lymphoma(NM_001003016) | | 1071-1089 BP | |
|---|---|---|---|---|
| gene | (SEQ ID NO: 498) SIRNA | Locus Stability | Expression inhibition ratio | Growth inhibition ratio |
| 71-3B | Specific modification (2'-O-methyl) 5-AGAGGACCUAGAAGGCGGCTT (SEQ ID NO: 524) TTUCUCCUGGAUCUUCCGCCG-5 (SEQ ID NO: 523) | ++ | 92% | 1% |

TABLE 72

| | dog B cell lymphoma(NM_001003016) | | 21-39 BP | |
|---|---|---|---|---|
| gene | (SEQ ID NO: 498) SIRNA | Locus Stability | Expression inhibition ratio | Growth inhibition ratio |
| 72-1 | Unmodified siRNA 5-AACUCUACUGUGGAGUCGGTT (SEQ ID NO: 525) TTUUGAGAUGACACCUCAGCC-5 (SEQ ID NO: 526) | + | 77% | 0% |
| 72-2 | Random modification (2'-O-methyl) 5-AACUCUACUGUGGAGUCGGTT (SEQ ID NO: 527) TTUUGAGAUGACACCUCAGCC-5 (SEQ ID NO: 528) | +++ | 57% | 32% |
| 72-3A | Specific modification (2'-O-methyl) 5-AACUCUACUGUGGAGUCGGTT (SEQ ID NO: 529) TTUUGAGAUGACACCUCAGCC-5 (SEQ ID NO: 530) | +++ | 68% | 8% |
| 72-3B | Specific modification (2'-O-methyl) 5-AACUCUACUGUGGAGUCGGTT (SEQ ID NO: 531) TTUUGAGAUGACACCUCAGCC-5 (SEQ ID NO: 532) | +++ | 69% | 1% |

TABLE 73

| | dog B cell lymphoma(NM_001003016) | | 124-142 BP | |
|---|---|---|---|---|
| gene | (SEQ ID NO: 498) SIRNA | Locus Stability | Expression inhibition ratio | Growth inhibition ratio |
| 73-1 | Unmodified siRNA 5-AGAAACGCAGUAAUCCGGATT (SEQ ID NO: 533) TTUCUUUGCGUCAUUAGGCCU-5 (SEQ ID NO: 534) | + | 86% | 0% |
| 73-2 | Random modification (2'-O-methyl) 5-AGAAACGCAGUAAUCCGGATT (SEQ ID NO: 535) TTUCUUUGCGUCAUUAGGCCU-5 (SEQ ID NO: 536) | +++ | 80% | 43% |
| 73-3A | Specific modification (2'-O-methyl) 5-AGAAACGCAGUAAUCCGGATT (SEQ ID NO: 537) TTUCUUUGCGUCAUUAGGCCU-5 (SEQ ID NO: 538) | ++ | 81% | 6% |
| 73-3B | Specific modification (2'-O-methyl) 5-AGAAACGCAGUAAUCCGGATT (SEQ ID NO: 539) TTUCUUUGCGUCAUUAGGCCU-5 (SEQ ID NO: 540) | ++ | 85% | 1% |

TABLE 74

| | dog B cell lymphoma (NM_001003016) | | 132-150 BP | |
|---|---|---|---|---|
| gene | (SEQ ID NO: 498)<br>SIRNA | Locus<br>Stability | Expression<br>inhibition ratio | Growth<br>inhibition ratio |
| 74-1 | Unmodified siRNA<br>5-AGUAAUCCGGACUCAACUCTT<br>(SEQ ID NO: 541)<br>TTUCAUUAGGCCUGAGUUGAG-5<br>(SEQ ID NO: 542) | + | 72% | 0% |
| 74-2 | Random modification (2'-deoxy-2'-fluoro)<br>5-AGUAAUCCGGACUCAACUCTT<br>(SEQ ID NO: 543)<br>TTUCAUUAGGCCUGAGUUGAG-5<br>(SEQ ID NO: 542) | ++ | 59% | 17% |
| 74-3A | Specific modification (2'-deoxy-2'-fluoro)<br>5-AGUAAUCCGGACUCAACUCTT<br>(SEQ ID NO: 544)<br>TTUCAUUAGGCCUGAGUUGAG-5<br>(SEQ ID NO: 545) | ++ | 68% | 4% |
| 74-3B | Specific modification (2'-deoxy-2'-fluoro)<br>5-AGUAAUCCGGACUCAACUCTT<br>(SEQ ID NO: 546)<br>TTUCAUUAGGCCUGAGUUGAG-5<br>(SEQ ID NO: 547) | ++ | 69% | 1% |

TABLE 75

| | dog B cell lymphoma (NM_001003016) | | 616-634 BP | |
|---|---|---|---|---|
| gene | (SEQ ID NO: 498)<br>SIRNA | Locus<br>Stability | Expression<br>inhibition ratio | Growth<br>inhibition ratio |
| 75-1 | Unmodified siRNA<br>5-GAGGAAGAUGAGUUGUACCTT<br>(SEQ ID NO: 548)<br>TTCUCCUUCUACUCAACAUGG-5<br>(SEQ ID NO: 549) | + | 81% | 0% |
| 75-2 | Random modification (2'-O-methyl)<br>5-GAGGAAGAUGAGUUGUACCTT<br>(SEQ ID NO: 550)<br>TTCUCCUUCUACUCAACAUGG-5<br>(SEQ ID NO: 549) | ++ | 70% | 29% |
| 75-3A | Specific modification (2'-O-methyl)<br>5-GAGGAAGAUGAGUUGUACCTT<br>(SEQ ID NO: 551)<br>TTCUCCUUCUACUCAACAUGG-5<br>(SEQ ID NO: 552) | +++ | 76% | 7% |
| 75-3B | Specific modification (2'-O-methyl)<br>5-GAGGAAGAUGAGUUGUACCTT<br>(SEQ ID NO: 553)<br>TTCUCCUUCUACUCAACAUGG-5<br>(SEQ ID NO: 554) | +++ | 77% | 2% |

TABLE 76

| | dog B cell lymphoma (NM_001003016) | | 993-1011 BP | |
|---|---|---|---|---|
| gene | (SEQ ID NO: 498)<br>SIRNA | Locus<br>Stability | Expression<br>inhibition ratio | Growth<br>inhibition ratio |
| 76-1 | Unmodified siRNA<br>5-AGAUGUUCUCGUAAGGACGTT<br>(SEQ ID NO: 555)<br>TTUCUACAAGAGCAUUCCUGC-5<br>(SEQ ID NO: 556) | + | 62% | 0% |

TABLE 76-continued

| | dog B cell lymphoma (NM_001003016) | | 993-1011 BP | |
|---|---|---|---|---|
| gene | (SEQ ID NO: 498) SIRNA | Locus Stability | Expression inhibition ratio | Growth inhibition ratio |
| 76-2 | Random modification (2'-O-methyl) 5-AGAUGUUCUCGUAAGGACGTT (SEQ ID NO: 557) TTUCUACAAGAGCAUUCCUGC-5 (SEQ ID NO: 556) | +++ | 53% | 17% |
| 76-3A | Specific modification (2'-O-methyl) 5-AGAUGUUCUCGUAAGGACGTT (SEQ ID NO: 558) TTUCUACAAGAGCAUUCCUGC-5 (SEQ ID NO: 559) | +++ | 60% | 6% |
| 76-3B | Specific modification (2'-O-methyl) 5-AGAUGUUCUCGUAAGGACGTT (SEQ ID NO: 555) TTUCUACAAGAGCAUUCCUGC-5 (SEQ ID NO: 560) | +++ | 69% | 1% |

TABLE 77

| | dog B cell lymphoma (NM_001003016) | | 999-1017 BP | |
|---|---|---|---|---|
| gene | (SEQ ID NO: 498) SIRNA | Locus Stability | Expression inhibition ratio | Growth inhibition ratio |
| 77-1 | Unmodified siRNA 5-UCUCGUAAGGACGAAACGATT (SEQ ID NO: 561) TTAGAGCAUUCCUGCUUUGCU-5 (SEQ ID NO: 562) | + | 58% | 0% |
| 77-2 | Random modification (2'-O-methyl) 5-UCUCGUAAGGACGAAACGATT (SEQ ID NO: 563) TTAGAGCAUUCCUGCUUUGCU-5 (SEQ ID NO: 562) | ++ | 34% | 21% |
| 77-3A | Specific modification (2'-O-methyl) 5-UCUCGUAAGGACGAAACGATT (SEQ ID NO: 564) TTAGAGCAUUCCUGCUUUGCU-5 (SEQ ID NO: 565) | ++ | 52% | 6% |
| 77-3B | Specific modification (2'-O-methyl) 5-UCUCGUAAGGACGAAACGATT (SEQ ID NO: 561) TTAGAGCAUUCCUGCUUUGCU-5 (SEQ ID NO: 566) | ++ | 55% | 0% |

TABLE 78

| | dog B cell lymphoma (NM_001003016) | | 1268-1286 BP | |
|---|---|---|---|---|
| gene | (SEQ ID NO: 498) SIRNA | Locus Stability | Expression inhibition ratio | Growth inhibition ratio |
| 78-1 | Unmodified siRNA 5-GCUGUAACCUCGGAGAGUUTT (SEQ ID NO: 567) TTCGACAUUGGAGCCUCUCAA-5 (SEQ ID NO: 568) | ++ | 71% | 0% |
| 78-2 | Random modification (2'-deoxy-2'-fluoro) 5-GCUGUAACCUCGGAGAGUUTT (SEQ ID NO: 569) TTCGACAUUGGAGCCUCUCAA-5 (SEQ ID NO: 568) | +++ | 51% | 23% |

TABLE 78-continued

| | dog B cell lymphoma(NM_001003016) | | 1268-1286 BP | |
|---|---|---|---|---|
| gene | (SEQ ID NO: 498) SIRNA | Locus Stability | Expression inhibition ratio | Growth inhibition ratio |
| 78-3A | Specific modification (2'-deoxy-2'-fluoro)<br>5-GCUGUAACCUCGGAGAGUUTT<br>(SEQ ID NO: 570)<br>TTCGACAUUGGAGCCUCUCAA-5<br>(SEQ ID NO: 571) | +++ | 62% | 4% |
| 78-3B | Specific modification (2'-deoxy-2'-fluoro)<br>5-GCUGUAACCUCGGAGAGUUTT<br>(SEQ ID NO: 572)<br>TTCGACAUUGGAGCCUCUCAA-5<br>(SEQ ID NO: 573) | +++ | 69% | 1% |

TABLE 79

| | dog B cell lymphoma(NM_001003016) | | 1275-1293 BP | |
|---|---|---|---|---|
| gene | (SEQ ID NO: 498) SIRNA | Locus Stability | Expression inhibition ratio | Growth inhibition ratio |
| 79-1 | Unmodified siRNA<br>5-CCUCGGAGAGUUCUACUCUTT<br>(SEQ ID NO: 574)<br>TTGGAGCCUCUCAAGAUGAGA-5<br>(SEQ ID NO: 575) | + | 87% | 0% |
| 79-2 | Random modification (2'-O-methyl)<br>5-CCUCGGAGAGUUCUACUCUTT<br>(SEQ ID NO: 576)<br>TTGGAGCCUCUCAAGAUGAGA-5<br>(SEQ ID NO: 575) | ++ | 34% | 27% |
| 79-3A | Specific modification (2'-O-methyl)<br>5-CCUCGGAGAGUUCUACUCUTT<br>(SEQ ID NO: 577)<br>TTGGAGCCUCUCAAGAUGAGA-5<br>(SEQ ID NO: 578) | ++ | 85% | 3% |
| 79-3B | Specific modification (2'-O-methyl)<br>5-CCUCGGAGAGUUCUACUCUTT<br>(SEQ ID NO: 574)<br>TTGGAGCCUCUCAAGAUGAGA-5<br>(SEQ ID NO: 579) | ++ | 85% | 0% |

TABLE 80

| | dog B cell lymphoma(NM_001003016) | | 1308-1326 BP | |
|---|---|---|---|---|
| gene | (SEQ ID NO: 498) SIRNA | Locus Stability | Expression inhibition ratio | Growth inhibition ratio |
| 80-1 | Unmodified siRNA<br>5-GCAAGUGGCAAGAGGAUUATT<br>(SEQ ID NO: 580)<br>TTCGUUCACCGUUCUCCUAAU-5<br>(SEQ ID NO: 581) | + | 71% | 0% |
| 80-2 | Random modification (2'-O-methyl)<br>5-GCAAGUGGCAAGAGGAUUATT<br>(SEQ ID NO: 582)<br>TTCGUUCACCGUUCUCCUAAU-5<br>(SEQ ID NO: 581) | ++ | 55% | 36% |
| 80-3A | Specific modification (2'-O-methyl)<br>5-GCAAGUGGCAAGAGGAUUATT<br>(SEQ ID NO: 583)<br>TTCGUUCACCGUUCUCCUAAU-5<br>(SEQ ID NO: 584) | ++ | 68% | 8% |

TABLE 80-continued

| gene | dog B cell lymphoma(NM_001003016) (SEQ ID NO: 498) SIRNA | Locus Stability | 1308-1326 BP Expression inhibition ratio | Growth inhibition ratio |
|---|---|---|---|---|
| 80-3B | Specific modification (2'-O-methyl)<br>5-GCAAGUGGCAAGAGGAUUATT<br>(SEQ ID NO: 585)<br>TTCGUUCACCGUUCUCCUAAU-5<br>(SEQ ID NO: 586) | ++ | 69% | 1% |

TABLE 81

| gene | dog B cell lymphoma(NM_001003016) (SEQ ID NO: 498) SIRNA | Locus Stability | 1347-1365 BP Expression inhibition ratio | Growth inhibition ratio |
|---|---|---|---|---|
| 81-1 | Unmodified siRNA<br>5-AUGGGAGAAGUAGUCCCCCTT<br>(SEQ ID NO: 587)<br>TTUACCCUCUUCAUCAGGGGG-5<br>(SEQ ID NO: 588) | + | 86% | 0% |
| 81-2 | Random modification (2'-O-methyl)<br>5-AUGGGAGAAGUAGUCCCCCTT<br>(SEQ ID NO: 589)<br>TTUACCCUCUUCAUCAGGGGG-5<br>(SEQ ID NO: 588) | +++ | 71% | 21% |
| 81-3A | Specific modification (2'-O-methyl)<br>5-AUGGGAGAAGUAGUCCCCCTT<br>(SEQ ID NO: 590)<br>TTUACCCUCUUCAUCAGGGGG-5<br>(SEQ ID NO: 591) | +++ | 82% | 4% |
| 81-3B | Specific modification (2'-O-methyl)<br>5-AUGGGAGAAGUAGUCCCCCTT<br>(SEQ ID NO: 592)<br>TTUACCCUCUUCAUCAGGGGG-5<br>(SEQ ID NO: 593) | +++ | 84% | 1% |

TABLE 82

| gene | dog B cell lymphoma(NM_001003016) (SEQ ID NO: 498) SIRNA | Locus Stability | 1354-1372 BP Expression inhibition ratio | Growth inhibition ratio |
|---|---|---|---|---|
| 82-1 | Unmodified siRNA<br>5-AAGUAGUCCCCCUUGAAGATT<br>(SEQ ID NO: 594)<br>TTUUCAUCAGGGGGAACUUCU-5<br>(SEQ ID NO: 595) | + | 75% | 0% |
| 82-2 | Random modification (2'-deoxy-2'-fluoro)<br>5-AAGUAGUCCCCCUUGAAGATT<br>(SEQ ID NO: 596)<br>TTUUCAUCAGGGGGAACUUCU-5<br>(SEQ ID NO: 595) | ++ | 53% | 27% |
| 82-3A | Specific modification (2'-deoxy-2'-fluoro)<br>5-AAGUAGUCCCCCUUGAAGATT<br>(SEQ ID NO: 597)<br>TTUUCAUCAGGGGGAACUUCU-5<br>(SEQ ID NO: 598) | ++ | 64% | 6% |
| 82-3B | Specific modification (2'-deoxy-2'-fluoro)<br>5-AAGUAGUCCCCCUUGAAGATT<br>(SEQ ID NO: 599)<br>TTUUCAUCAGGGGGAACUUCU-5<br>(SEQ ID NO: 600) | ++ | 69% | 1% |

TABLE 83

| gene | dog B cell lymphoma(NM_001003016) (SEQ ID NO: 498) SIRNA | Locus Stability | 1461-1479 BP Expression inhibition ratio | Growth inhibition ratio |
|---|---|---|---|---|
| 83-1 | Unmodified siRNA<br>5-GGUAGGGUUGAAGAGACUUTT<br>(SEQ ID NO: 601)<br>TTCCAUCCCAACUUCUCUGAA-5<br>(SEQ ID NO: 602) | + | 97% | 0% |
| 83-2 | Random modification (2'-O-methyl)<br>5-GGUAGGGUUGAAGAGACUUTT<br>(SEQ ID NO: 603)<br>TTCCAUCCCAACUUCUCUGAA-5<br>(SEQ ID NO: 604) | +++ | 58% | 27% |
| 83-3A | Specific modification (2'-O-methyl)<br>5-GG<u>U</u>AGGG<u>UU</u>GAAGAGACUUTT<br>(SEQ ID NO: 605)<br>TTCC<u>A</u>U<u>C</u>CCAAC<u>U</u>UCUCUGAA-5<br>(SEQ ID NO: 606) | +++ | 94% | 3% |
| 83-3B | Specific modification (2'-O-methyl)<br>5-GG<u>U</u>AGGG<u>UU</u>GAAGAGACUUTT<br>(SEQ ID NO: 605)<br>TTCC<u>A</u>U<u>C</u>CCAACUUCUCUGAA-5<br>(SEQ ID NO: 607) | +++ | 95% | 0% |

TABLE 84

| gene | rat(NM_001014070.1) (SEQ ID NO: 608) SIRNA | Locus Stability | 623-641 BP Expression inhibition ratio | Growth inhibition ratio |
|---|---|---|---|---|
| 84-1 | Unmodified siRNA<br>5-AGCGCUUAAAGGGCGAGAAGATT<br>(SEQ ID NO: 609)<br>TTUCGCGAAUUUCCCGCUCUUCU-5<br>(SEQ ID NO: 610) | ++ | 86% | 0% |
| 84-2 | Random modification (2'-O-methyl)<br>5-AGCGCUUAAAGGGCGAGAAGATT<br>(SEQ ID NO: 611)<br>TTUCGCGAAUUUCCCGCUCUUCU-5<br>(SEQ ID NO: 610) | +++ | 49% | 25% |
| 84-3A | Specific modification (2'-O-methyl)<br>5-AGCGCU<u>U</u>AAAGGGCG<u>A</u>GAAGATT<br>(SEQ ID NO: 612)<br>TTUCGCGA<u>A</u>U<u>U</u>UCCCGCUCUUCU-5<br>(SEQ ID NO: 613) | +++ | 85% | 7% |
| 84-3B | Specific modification (2'-O-methyl)<br>5-AGCGCU<u>U</u>AAAGGGCGAGAAGATT<br>(SEQ ID NO: 614)<br>TTUCGCGA<u>A</u>UUUCCCGCUCUUCU-5<br>(SEQ ID NO: 615) | +++ | 85% | 1% |

TABLE 85

| gene | rat(NM_001014070.1) (SEQ ID NO: 608) SIRNA | Locus Stability | 2541-2559 BP Expression inhibition ratio | Growth inhibition ratio |
|---|---|---|---|---|
| 85-1 | Unmodified siRNA<br>5-GGCCUUUCUCUCUAGAUAUTT<br>(SEQ ID NO: 616)<br>TTCCGGAAAGAGAGAUCUAUA-5<br>(SEQ ID NO: 617) | + | 91% | 0% |

TABLE 85-continued

| | rat(NM_001014070.1) (SEQ ID NO: 608) | | 2541-2559 BP | |
|---|---|---|---|---|
| gene | SIRNA | Locus Stability | Expression inhibition ratio | Growth inhibition ratio |
| 85-2 | Random modification (2'-O-methyl)<br>5-GGCCUUUCUCUCUAGAUAUTT<br>(SEQ ID NO: 618)<br>TTCCGGAAAGAGAGAUCUAUA-5<br>(SEQ ID NO: 617) | +++ | 80% | 31% |
| 85-3A | Specific modification (2'-O-methyl)<br>5-GGCCUUUCUCUC<u>UAG</u>A<u>UA</u>UTT<br>(SEQ ID NO: 619)<br>TTCCGGAAAGAGAG<u>AU</u>CU<u>AUA</u>-5<br>(SEQ ID NO: 620) | +++ | 89% | 5% |
| 85-3B | Specific modification (2'-O-methyl)<br>5-GGCCUUUCUCUC<u>UAG</u>A<u>UA</u>UTT<br>(SEQ ID NO: 616)<br>TTCCGGAAAGAGAG<u>AU</u>CU<u>AUA</u>-5<br>(SEQ ID NO: 621) | +++ | 90% | 1% |

TABLE 86

| | rat(NM_001014070.1) (SEQ ID NO: 608) | | 2785-2803 BP | |
|---|---|---|---|---|
| gene | SIRNA | Locus Stability | Expression inhibition ratio | Growth inhibition ratio |
| 86-1 | Unmodified siRNA<br>5-GCCUCUCUAUCCUUAGCUUTT<br>(SEQ ID NO: 622)<br>TTCGGAGAGAUAGGAAUCGAA-5<br>(SEQ ID NO: 623) | + | 49% | 0% |
| 86-2 | Random modification (2'-deoxy-2'-fluoro)<br>5-GCCUCUCUAUCCUUAGCUUTT<br>(SEQ ID NO: 624)<br>TTCGGAGAGAUAGGAAUCGAA-5<br>(SEQ ID NO: 625) | +++ | 34% | 37% |
| 86-3A | Specific modification (2'-deoxy-2'-fluoro)<br>5-GCCUCUC<u>UA</u>UCCU<u>UA</u>GCUUTT<br>(SEQ ID NO: 626)<br>TTCGGAGAG<u>AU</u>AGG<u>AAU</u>CGAA-5<br>(SEQ ID NO: 627) | +++ | 47% | 6% |
| 86-3B | Specific modification (2'-deoxy-2'-fluoro)<br>5-GCCUCUC<u>UA</u>UCCU<u>UA</u>GCUUTT<br>(SEQ ID NO: 622)<br>TTCGGAGAG<u>AU</u>AGG<u>AAU</u>CGAA-5<br>(SEQ ID NO: 628) | +++ | 48% | 1% |

TABLE 87

| | rat(NM_001014070.1) (SEQ ID NO: 608) | | 487-505 BP | |
|---|---|---|---|---|
| gene | SIRNA | Locus Stability | Expression inhibition ratio | Growth inhibition ratio |
| 87-1 | Unmodified siRNA<br>5-AAGGACCUAGAGGAGUCACTT<br>(SEQ ID NO: 629)<br>TTUUCCUGGAUCUCCUCAGUG-5<br>(SEQ ID NO: 630) | + | 90% | 0% |
| 87-2 | Random modification (2'-deoxy-2'-fluoro)<br>5-AAGGACCUAGAGGAGUCACTT<br>(SEQ ID NO: 631)<br>TTUUCCUGGAUCUCCUCAGUG-5<br>(SEQ ID NO: 630) | ++ | 31% | 25% |

TABLE 87-continued

| gene | rat(NM_001014070.1) (SEQ ID NO: 608) SIRNA | Locus Stability | 487-505 BP Expression inhibition ratio | Growth inhibition ratio |
|---|---|---|---|---|
| 87-3A | Specific modification (2'-deoxy-2'-fluoro)<br>5-AAGGACCUAGAGGAGUCACTT<br>(SEQ ID NO: 632)<br>TTUUCCGGAUCUCCUCAGUG-5<br>(SEQ ID NO: 633) | ++ | 87% | 4% |
| 87-3B | Specific modification (2'-deoxy-2'-fluoro)<br>5-AAGGACCUAGAGGAGUCACTT<br>(SEQ ID NO: 634)<br>TTUUCCGGAUCUCCUCAGUG-5<br>(SEQ ID NO: 635) | ++ | 88% | 1% |

TABLE 88

| gene | rat(NM_001014070.1) (SEQ ID NO: 608) SIRNA | Locus Stability | 614-632 BP Expression inhibition ratio | Growth inhibition ratio |
|---|---|---|---|---|
| 88-1 | Unmodified siRNA<br>5-CUGACCGGAAGCGCUUAAATT<br>(SEQ ID NO: 636)<br>TTGACUGGCCUUCGCGAAUUU-5<br>(SEQ ID NO: 637) | + | 87% | 0% |
| 88-2 | Random modification (2'-O-methyl)<br>5-CUGACCGGAAGCGCUUAAATT<br>(SEQ ID NO: 638)<br>TTGACUGGCCUUCGCGAAUUU-5<br>(SEQ ID NO: 639) | +++ | 27% | 37% |
| 88-3A | Specific modification (2'-O-methyl)<br>5-CUGACCGGAAGCGCUUAAATT<br>(SEQ ID NO: 640)<br>TTGACUGGCCUUCGCGAAUUU-5<br>(SEQ ID NO: 641) | +++ | 85% | 5% |
| 88-3B | Specific modification (2'-O-methyl)<br>5-CUGACCGGAAGCGCUUAAATT<br>(SEQ ID NO: 642)<br>TTGACUGGCCUUCGCGAAUUU-5<br>(SEQ ID NO: 643) | +++ | 86% | 1% |

TABLE 89

| gene | rat(NM_001014070.1) (SEQ ID NO: 608) SIRNA | Locus Stability | 628-646 BP Expression inhibition ratio | Growth inhibition ratio |
|---|---|---|---|---|
| 89-1 | Unmodified siRNA<br>5-UUAAAGGGCGAGAAGACCGTT<br>(SEQ ID NO: 644)<br>TTAAUUUCCCGCUCUUCUGGC-5<br>(SEQ ID NO: 645) | ++ | 89% | 0% |
| 89-2 | Random modification (2'-O-methyl)<br>5-UUAAAGGGCGAGAAGACCGTT<br>(SEQ ID NO: 646)<br>TTAAUUUCCCGCUCUUCUGGC-5<br>(SEQ ID NO: 645) | +++ | 67% | 47% |
| 89-3A | Specific modification (2'-O-methyl)<br>5-UUAAAGGGCGAGAAGACCGTT<br>(SEQ ID NO: 647)<br>TTAAUUUCCCGCUCUUCUGGC-5<br>(SEQ ID NO: 648) | +++ | 85% | 3% |

TABLE 89-continued

|  |  |  | 628-646 BP | |
| --- | --- | --- | --- | --- |
| gene | rat(NM_001014070.1) (SEQ ID NO: 608) SIRNA | Locus Stability | Expression inhibition ratio | Growth inhibition ratio |
| 89-3B | Specific modification (2'-O-methyl) 5-UUAAAGGGCGAGAAGACCGTT (SEQ ID NO: 649) TTAAUUUCCCGCUCUUCUGGC-5 (SEQ ID NO: 650) | +++ | 87% | 0% |

TABLE 90

|  |  |  | 1257-1275 BP | |
| --- | --- | --- | --- | --- |
| gene | rat(NM_001014070.1) (SEQ ID NO: 608) SIRNA | Locus Stability | Expression inhibition ratio | Growth inhibition ratio |
| 90-1 | Unmodified siRNA 5-GAAGAGCCUACACAACCCUTT (SEQ ID NO: 651) TTCUUCUCGGAUGUGUUGGGA-5 (SEQ ID NO: 652) | + | 77% | 0% |
| 90-2 | Random modification (2'-O-methyl) 5-GAAGAGCCUACACAACCCUTT (SEQ ID NO: 653) TTCUUCUCGGAUGUGUUGGGA-5 (SEQ ID NO: 654) | ++ | 50% | 27% |
| 90-3A | Specific modification (2'-O-methyl) 5-GAAGAGCCUACACAACCCUTT (SEQ ID NO: 655) TTCUUCUCGGAUGUGUUGGGA-5 (SEQ ID NO: 656) | ++ | 75% | 5% |
| 90-3B | Specific modification (2'-O-methyl) 5-GAAGAGCCUACACAACCCUTT (SEQ ID NO: 657) TTCUUCUCGGAUGUGUUGGGA-5 (SEQ ID NO: 658) | ++ | 76% | 1% |

TABLE 91

|  |  |  | 1288-1306 BP | |
| --- | --- | --- | --- | --- |
| gene | rat(NM_001014070.1) (SEQ ID NO: 608) SIRNA | Locus Stability | Expression inhibition ratio | Growth inhibition ratio |
| 91-1 | Unmodified siRNA 5-CUAGAGGAUCUUGAAGACCTT (SEQ ID NO: 659) TTGAUCUCCUAGAACUUCUGG-5 (SEQ ID NO: 660) | + | 83% | 0% |
| 91-2 | Random modification (2'-deoxy-2'-fluoro) 5-CUAGAGGAUCUUGAAGACCTT (SEQ ID NO: 661) TTGAUCUCCUAGAACUUCUGG-5 (SEQ ID NO: 660) | ++ | 61% | 25% |
| 91-3A | Specific modification (2'-deoxy-2'-fluoro) 5-CUAGAGGAUCUUGAAGACCTT (SEQ ID NO: 662) TTGAUCUCCUAGAACUUCUGG-5 (SEQ ID NO: 663) | ++ | 78% | 6% |
| 91-3B | Specific modification (2'-deoxy-2'-fluoro) 5-CUAGAGGAUCUUGAAGACCTT (SEQ ID NO: 664) TTGAUCUCCUAGAACUUCUGG-5 (SEQ ID NO: 660) | ++ | 81% | 1% |

TABLE 92

| gene | rat(NM_001014070.1) (SEQ ID NO: 608) SIRNA | Locus Stability | 1427-1445 BP Expression inhibition ratio | Growth inhibition ratio |
|---|---|---|---|---|
| 92-1 | Unmodified siRNA<br>5-ACAUAGAGGAAGACGCGGATT<br>(SEQ ID NO: 665)<br>TTUGUAUCUCCUUCUGCGCCU-5<br>(SEQ ID NO: 666) | + | 91% | 0% |
| 92-2 | Random modification (2'-deoxy-2'-fluoro)<br>5-ACAUAGAGGAAGACGCGGATT<br>(SEQ ID NO: 667)<br>TTUGUAUCUCCUUCUGCGCCU-5<br>(SEQ ID NO: 668) | +++ | 57% | 34% |
| 92-3A | Specific modification (2'-deoxy-2'-fluoro)<br>5-AC<u>AU</u>AGGAAGACGCGGATT<br>(SEQ ID NO: 669)<br>TTUGU<u>AU</u>CUCCUUCUGCGCCU-5<br>(SEQ ID NO: 670) | +++ | 86% | 6% |
| 92-3B | Specific modification (2'-deoxy-2'-fluoro)<br>5-ACA<u>U</u>AGAGGAAGACGCGGATT<br>(SEQ ID NO: 669)<br>TTUGU<u>AU</u>CUCCUUCUGCGCCU-5<br>(SEQ ID NO: 671) | +++ | 89% | 0% |

TABLE 93

| gene | rat(NM_001014070.1) (SEQ ID NO: 608) SIRNA | Locus Stability | 2091-2109 BP Expression inhibition ratio | Growth inhibition ratio |
|---|---|---|---|---|
| 93-1 | Unmodified siRNA<br>5-AUCGUCGUCAGGGUAAGGUTT<br>(SEQ ID NO: 672)<br>TTUAGCAGCAGUCCCAUUCCA-5<br>(SEQ ID NO: 673) | + | 50% | 0% |
| 93-2 | Random modification (2'-O-methyl)<br>5-AUCGUCGUCAGGGUAAGGUTT<br>(SEQ ID NO: 674)<br>TTUAGCAGCAGUCCCAUUCCA-5<br>(SEQ ID NO: 675) | ++ | 34% | 37% |
| 93-3A | Specific modification (2'-O-methyl)<br>5-AUCGUCGUCAGGG<u>UA</u>AGGUTT<br>(SEQ ID NO: 676)<br>TTUAGCAGCAGUCCC<u>AU</u>UCCA-5<br>(SEQ ID NO: 677) | ++ | 47% | 4% |
| 93-3B | Specific modification (2'-O-methyl)<br>5-AUCGUCGUCAGGG<u>U</u>AAGGUTT<br>(SEQ ID NO: 678)<br>TTUAGCAGCAGUCCC<u>AU</u>UCCA-5<br>(SEQ ID NO: 679) | ++ | 49% | 1% |

TABLE 94

| gene | rat(NM_001014070.1) (SEQ ID NO: 608) SIRNA | Locus Stability | 2537-2555 BP Expression inhibition ratio | Growth inhibition ratio |
|---|---|---|---|---|
| 94-1 | Unmodified siRNA<br>5-CUCUGGCCUUUCUCUCUAGTT<br>(SEQ ID NO: 680)<br>TTGAGACCGGAAAGAGAGAUC-5<br>(SEQ ID NO: 681) | + | 48% | 0% |

TABLE 94-continued

| | | | 2537-2555 BP | |
|---|---|---|---|---|
| gene | rat(NM_001014070.1) (SEQ ID NO: 608) SIRNA | Locus Stability | Expression inhibition ratio | Growth inhibition ratio |
| 94-2 | Random modification (2'-O-methyl) 5-CUCUGGCCUUUCUCUCUAGTT (SEQ ID NO: 682) TTGAGACCGGAAAGAGAGAUC-5 (SEQ ID NO: 681) | ++ | 24% | 22% |
| 94-3A | Specific modification (2'-O-methyl) 5-CUCUGGCCUUUCUCUC<u>UAG</u>TT (SEQ ID NO: 683) TTGAGACCGGAAAGAGAG<u>AU</u>C-5 (SEQ ID NO: 684) | ++ | 45% | 5% |
| 94-3B | Specific modification (2'-O-methyl) 5-CUCUGGCCUUUCUCUC<u>UAG</u>TT (SEQ ID NO: 685) TTGAGACCGGAAAGAGAG<u>AU</u>C-5 (SEQ ID NO: 681) | ++ | 47% | 1% |

TABLE 95

| | | | 2688-2706 BP | |
|---|---|---|---|---|
| gene | rat(NM_001014070.1) (SEQ ID NO: 608) SIRNA | Locus Stability | Expression inhibition ratio | Growth inhibition ratio |
| 95-1 | Unmodified siRNA 5-GACAAGGGAAGGUUAGCCUTT (SEQ ID NO: 686) TTCUGUUCCCUUCCAAUCGGA-5 (SEQ ID NO: 687) | + | 73% | 0% |
| 95-2 | Random modification (2'-O-methyl) 5-GACAAGGGAAGGUUAGCCUTT (SEQ ID NO: 688) TTCUGUUCCCUUCCAAUCGGA-5 (SEQ ID NO: 687) | +++ | 34% | 29% |
| 95-3A | Specific modification (2'-O-methyl) 5-GACAAGGGAAGGU<u>UA</u>GCCUTT (SEQ ID NO: 689) TTCUGU<u>U</u>CCCUUCCA<u>AU</u>CGGA-5 (SEQ ID NO: 690) | +++ | 68% | 6% |
| 95-3B | Specific modification (2'-O-methyl) 5-GACAAGGGAAGGU<u>UA</u>GCCUTT (SEQ ID NO: 691) TTCUGUUCCCUUCCA<u>AU</u>CGGA-5 (SEQ ID NO: 692) | +++ | 72% | 1% |

TABLE 96

| | | | 2988-2006 BP | |
|---|---|---|---|---|
| gene | rat(NM_001014070.1) (SEQ ID NO: 608) SIRNA | Locus Stability | Expression inhibition ratio | Growth inhibition ratio |
| 96-1 | Unmodified siRNA 5-AGACUAAGCCCAAAAGGGCTT (SEQ ID NO: 693) TTUCUGAUUCGGGUUUUCCCG-5 (SEQ ID NO: 694) | + | 48% | 0% |
| 96-2 | Random modification (2'-deoxy-2'-fluoro) 5-AGACUAAGCCCAAAAGGGCTT (SEQ ID NO: 695) TTUCUGAUUCGGGUUUUCCCG-5 (SEQ ID NO: 694) | +++ | 26% | 21% |

TABLE 96-continued

| gene | rat(NM_001014070.1) (SEQ ID NO: 608) SIRNA | Locus Stability | 2988-2006 BP Expression inhibition ratio | Growth inhibition ratio |
|---|---|---|---|---|
| 96-3A | Specific modification (2'-deoxy-2'-fluoro)<br>5-AGAC<u>U</u>AAGCCC<u>A</u>AAAGGGCTT<br>(SEQ ID NO: 696)<br>TTUCUGA<u>U</u>UCGGG<u>U</u>UUUCCCG-5<br>(SEQ ID NO: 697) | +++ | 45% | 5% |
| 96-3B | Specific modification (2'-deoxy-2'-fluoro)<br>5-AGAC<u>U</u>AAGCCCAAAAGGGCTT<br>(SEQ ID NO: 698)<br>TTUCUGA<u>U</u>UCGGGUUUUCCCG-5<br>(SEQ ID NO: 699) | +++ | 47% | 1% |

TABLE 97

| gene | rat(NM_001014070.1) (SEQ ID NO: 608) SIRNA | Locus Stability | 3132-3150 BP Expression inhibition ratio | Growth inhibition ratio |
|---|---|---|---|---|
| 97-1 | Unmodified siRNA<br>5-CCUCCCCAUCCCCUUUUAATT<br>(SEQ ID NO: 700)<br>TTGGAGGGGUAGGGGAAAAUU-5<br>(SEQ ID NO: 701) | + | 81% | 0% |
| 97-2 | Random modification (2'-O-methyl)<br>5-CCUCCCCAUCCCCUUUUAATT<br>(SEQ ID NO: 702)<br>TTGGAGGGGUAGGGGAAAAUU-5<br>(SEQ ID NO: 703) | ++ | 48% | 44% |
| 97-3A | Specific modification (2'-O-methyl)<br>5-CCUCCCCAUCCCCUUU<u>UA</u>ATT<br>(SEQ ID NO: 704)<br>TTGGAGGGG<u>U</u>AGGGGAAA<u>A</u>UU-5<br>(SEQ ID NO: 705) | ++ | 80% | 4% |
| 97-3B | Specific modification (2'-O-methyl)<br>5-CCUCCCCAUCCCCUUU<u>U</u>AATT<br>(SEQ ID NO: 700)<br>TTGGAGGGGUAGGGGAAA<u>A</u>UU-5<br>(SEQ ID NO: 706) | ++ | 80% | 0% |

TABLE 98

| gene | rat(NM_001014070.1) (SEQ ID NO: 608) SIRNA | Locus Stability | 3471-3489 BP Expression inhibition ratio | Growth inhibition ratio |
|---|---|---|---|---|
| 98-1 | Unmodified siRNA<br>5-AUCAGAGGGAGGUCUUAGATT<br>(SEQ ID NO: 707)<br>TTUAGUCUCCCUCCAGAAUCU-5<br>(SEQ ID NO: 708) | + | 73% | 0% |
| 98-2 | Random modification (2'-O-methyl)<br>5-AUCAGAGGGAGGUCUUAGATT<br>(SEQ ID NO: 709)<br>TTUAGUCUCCCUCCAGAAUCU-5<br>(SEQ ID NO: 710) | ++ | 19% | 32% |
| 98-3A | Specific modification (2'-O-methyl)<br>5-AUCAGAGGGAGGUCU<u>UA</u>GATT<br>(SEQ ID NO: 711)<br>TTAGU<u>C</u>UCCCUCCAGA<u>AU</u>CU-5<br>(SEQ ID NO: 712) | ++ | 68% | 6% |

TABLE 98-continued

|  |  |  | 3471-3489 BP | |
|---|---|---|---|---|
| gene | rat(NM_001014070.1) (SEQ ID NO: 608) SIRNA | Locus Stability | Expression inhibition ratio | Growth inhibition ratio |
| 98-3B | Specific modification (2'-O-methyl)<br>5-AUCAGAGGGAGGUCU<u>UA</u>GATT<br>(SEQ ID NO: 713)<br>TTUAGUCUCCUCCAGA<u>AU</u>CU-5<br>(SEQ ID NO: 714) | ++ | 69% | 1% |

TABLE 99

|  |  |  | 3477-3495 BP | |
|---|---|---|---|---|
| gene | rat(NM_001014070.1) (SEQ ID NO: 608) SIRNA | Locus Stability | Expression inhibition ratio | Growth inhibition ratio |
| 99-1 | Unmodified siRNA<br>5-GGGAGGUCUUAGAAAACACTT<br>(SEQ ID NO: 715)<br>TTCCCUCCAGAAUCUUUUGUG-5<br>(SEQ ID NO: 716) | + | 84% | 0% |
| 99-2 | Random modification (2'-O-methyl)<br>5-GGGAGGUCUUAGAAAACACTT<br>(SEQ ID NO: 717)<br>TTCCCUCCAGAAUCUUUUGUG-5<br>(SEQ ID NO: 716) | ++ | 17% | 31% |
| 99-3A | Specific modification (2'-O-methyl)<br>5-GGGAGGUCU<u>UA</u>GAAAACACTT<br>(SEQ ID NO: 718)<br>TTCCCUCCAGA<u>AU</u>CUUUUGUG-5<br>(SEQ ID NO: 719) | ++ | 84% | 3% |
| 99-3B | Specific modification (2'-O-methyl)<br>5-GGGAGGUCU<u>UA</u>GAAAACACTT<br>(SEQ ID NO: 715)<br>TTCCCUCCAGA<u>AU</u>CUUUUGUG-5<br>(SEQ ID NO: 720) | ++ | 82% | 0% |

TABLE 100

|  |  |  | 3613-3631 BP | |
|---|---|---|---|---|
| gene | rat(NM_001014070.1) (SEQ ID NO: 608) SIRNA | Locus Stability | Expression inhibition ratio | Growth inhibition ratio |
| 100-1 | Unmodified siRNA<br>5-GGCUUAGUCACUCCCUCUUCTT<br>(SEQ ID NO: 721)<br>TTCCGAAUCAGUGAGGAGAAG-5<br>(SEQ ID NO: 722) | + | 71% | 0% |
| 100-2 | Random modification (2'-deoxy-2'-fluoro)<br>5-GGCUUAGUCACUCCCUCUUCTT<br>(SEQ ID NO: 723)<br>TTCCGAAUCAGUGAGGAGAAG-5<br>(SEQ ID NO: 722) | ++ | 23% | 14% |
| 100-3A | Specific modification (2'-deoxy-2'-fluoro)<br>5-GGCU<u>UA</u>GUCACUCCCUCUUCTT<br>(SEQ ID NO: 724)<br>TTCCGA<u>AU</u>CAGUGAGGAGAAG-5<br>(SEQ ID NO: 725) | ++ | 68% | 4% |
| 100-3B | Specific modification (2'-deoxy-2'-fluoro)<br>5-GGCU<u>UA</u>GUCACUCCCUCUUCTT<br>(SEQ ID NO: 726)<br>TTCCGA<u>AU</u>CAGUGAGGAGAAG-5<br>(SEQ ID NO: 727) | ++ | 69% | 1% |

TABLE 101

| gene | Rat BIRC5 (NM_022274)<br>(SEQ ID NO: 728)<br>SIRNA | Locus<br>Stability | 42-60 BP<br>Expression<br>inhibition ratio | Growth<br>inhibition ratio |
|---|---|---|---|---|
| 101-1 | Unmodified siRNA<br>5-ACCUUAAGGACCACCGGAUTT<br>(SEQ ID NO: 729)<br>TTUGGAAUUCCUGGUGGCCUA-5<br>(SEQ ID NO: 730) | + | 77% | 0% |
| 101-2 | Random modification (2'-O-methyl)<br>5-ACCUUAAGGACCACCGGAUTT<br>(SEQ ID NO: 731)<br>TTUGGAAUUCCUGGUGGCCUA-5<br>(SEQ ID NO: 732) | ++ | 52% | 24% |
| 101-3A | Specific modification (2'-O-methyl)<br>5-ACCU<u>UA</u>AGGACCACCGGAUTT<br>(SEQ ID NO: 733)<br>TTGGA<u>AU</u>UCCUGGUGGCCUA-5<br>(SEQ ID NO: 734) | ++ | 72% | 6% |
| 101-3B | Specific modification (2'-O-methyl)<br>5-ACCU<u>U</u>AAGGACCACCGGAUTT<br>(SEQ ID NO: 735)<br>TTGGA<u>A</u>UUCCUGGUGGCCUA-5<br>(SEQ ID NO: 736) | ++ | 74% | 1% |

TABLE 102

| gene | Rat BIRC5 (NM_022274)<br>(SEQ ID NO: 728)<br>SIRNA | Locus<br>Stability | 56-74 BP<br>Expression<br>inhibition ratio | Growth<br>inhibition ratio |
|---|---|---|---|---|
| 102-1 | Unmodified siRNA<br>5-CGGAUCUACACCUUCAAGATT<br>(SEQ ID NO: 737)<br>TTGCCUAGAUGUGGAAGUUCU-5<br>(SEQ ID NO: 738) | + | 73% | 0% |
| 102-2 | Random modification (2'-O-methyl)<br>5-CGGAUCUACACCUUCAAGATT<br>(SEQ ID NO: 739)<br>TTGCCUAGAUGUGGAAGUUCU-5<br>(SEQ ID NO: 740) | ++ | 46% | 19% |
| 102-3A | Specific modification (2'-O-methyl)<br>5-CGGAUC<u>UAC</u>ACCUUCAAGATT<br>(SEQ ID NO: 741)<br>TTGCCUAGA<u>UG</u>UGGAAGUUCU-5<br>(SEQ ID NO: 742) | ++ | 68% | 5% |
| 102-3B | Specific modification (2'-O-methyl)<br>5-CGGAUC<u>U</u>ACACCUUCAAGATT<br>(SEQ ID NO: 743)<br>TTGCCUAGA<u>U</u>GUGGAAGUUCU-5<br>(SEQ ID NO: 744) | ++ | 69% | 1% |

TABLE 103

| gene | Rat BIRC5 (NM_022274)<br>(SEQ ID NO: 728)<br>SIRNA | Locus<br>Stability | 145-163 BP<br>Expression<br>inhibition ratio | Growth<br>inhibition ratio |
|---|---|---|---|---|
| 103-1 | Unmodified siRNA<br>5-UACCGAGAAUGAGCCUGAUTT<br>(SEQ ID NO: 745)<br>TTAUGGCUCUUACUCGGACUA-5<br>(SEQ ID NO: 746) | + | 57% | 0% |

TABLE 103-continued

| gene | Rat BIRC5(NM_022274)<br>(SEQ ID NO: 728)<br>SIRNA | Locus<br>Stability | 145-163 BP | |
|---|---|---|---|---|
| | | | Expression<br>inhibition ratio | Growth<br>inhibition ratio |
| 103-2 | Random modification (2'-O-methyl)<br>5-UACCGAGAAUGAGCCUGAUTT<br>(SEQ ID NO: 747)<br>TTAUGGCUCUUACUCGGACUA-5<br>(SEQ ID NO: 748) | +++ | 23% | 27% |
| 103-3A | Specific modification (2'-O-methyl)<br>5-<u>U</u>ACCGAGAA<u>U</u>GAGCC<u>U</u>GAUTT<br>(SEQ ID NO: 749)<br>TT<u>A</u>UGGCUCUUAC<u>U</u>CGGA<u>C</u>UA-5<br>(SEQ ID NO: 750) | +++ | 54% | 6% |
| 103-3B | Specific modification (2'-O-methyl)<br>5-<u>U</u>ACCGAGAAUGAGCCUGAUTT<br>(SEQ ID NO: 751)<br>TT<u>A</u>UGGCUCUUACUCGGACUA-5<br>(SEQ ID NO: 752) | +++ | 55% | 1% |

TABLE 104

| gene | Rat BIRC5(NM_022274)<br>(SEQ ID NO: 728)<br>SIRNA | Locus<br>Stability | 183-201 BP | |
|---|---|---|---|---|
| | | | Expression<br>inhibition ratio | Growth<br>inhibition ratio |
| 104-1 | Unmodified siRNA<br>5-GCUUUAAGGAACUGGAAGGTT<br>(SEQ ID NO: 753)<br>TTCGAAAUUCCUUGACCUUCC-5<br>(SEQ ID NO: 754) | + | 38% | 0% |
| 104-2 | Random modification (2'-O-methyl)<br>5-GCUUUAAGGAACUGGAAGGTT<br>(SEQ ID NO: 755)<br>TTCGAAAUUCCUUGACCUUCC-5<br>(SEQ ID NO: 756) | ++ | 25% | 19% |
| 104-3A | Specific modification (2'-O-methyl)<br>5-GCUU<u>U</u>AAGGAAC<u>U</u>GGAAGGTT<br>(SEQ ID NO: 757)<br>TTCGAA<u>A</u>UUCCUUGA<u>C</u>CUUCC-5<br>(SEQ ID NO: 758) | ++ | 37% | 3% |
| 104-3B | Specific modification (2'-O-methyl)<br>5-GCUU<u>U</u>AAGGAACUGGAAGGTT<br>(SEQ ID NO: 753)<br>TTCGAA<u>AU</u>UCCUUGACCUUCC-5<br>(SEQ ID NO: 759) | ++ | 37% | 0% |

TABLE 105

| gene | mice(NM_008960.2) (SEQ ID NO: 19)<br>SIRNA | Locus<br>Stability | 247-265 BP | |
|---|---|---|---|---|
| | | | Expression<br>inhibition ratio | Growth<br>inhibition ratio |
| 105-1 | Unmodified siRNA<br>5-UCCUCGUCGUCUGUUCUAATT<br>(SEQ ID NO: 760)<br>TTAGGAGCAGCAGACAAGAUU-5<br>(SEQ ID NO: 761) | + | 86% | 0% |
| 105-2 | Random modification (2'-O-methyl)<br>5-UCCUCGUCGUCUGUUCUAATT<br>(SEQ ID NO: 762)<br>TTAGGAGCAGCAGACAAGAUU-5<br>(SEQ ID NO: 763) | +++ | 63% | 35% |

TABLE 105-continued

| gene | mice(NM_008960.2) (SEQ ID NO: 19) SIRNA | Locus Stability | 247-265 BP Expression inhibition ratio | Growth inhibition ratio |
|---|---|---|---|---|
| 105-3A | Specific modification (2'-O-methyl)<br>5-UCCUCGUCGUCUGUUCUAATT<br>(SEQ ID NO: 764)<br>TTAGGAGCAGCAGACAAGAUU-5<br>(SEQ ID NO: 765) | +++ | 82% | 4% |
| 105-3B | Specific modification (2'-O-methyl)<br>5-UCCUCGUCGUCUGUUCUAATT<br>(SEQ ID NO: 766)<br>TTAGGAGCAGCAGACAAGAUU-5<br>(SEQ ID NO: 767) | +++ | 84% | 1% |

TABLE 106

| gene | mice(NM_008960.2) (SEQ ID NO: 19) SIRNA | Locus Stability | 260-278 BP Expression inhibition ratio | Growth inhibition ratio |
|---|---|---|---|---|
| 106-1 | Unmodified siRNA<br>5-UUCUAACCGGGCAGCUUCUTT<br>(SEQ ID NO: 768)<br>TTAAGAUUGGCCCGUCGAAGA-5<br>(SEQ ID NO: 769) | ++ | 73% | 0% |
| 106-2 | Random modification (2'-deoxy-2'-fluoro)<br>5-UUCUAACCGGGCAGCUUCUTT<br>(SEQ ID NO: 770)<br>TTAAGAUUGGCCCGUCGAAGA-5<br>(SEQ ID NO: 769) | +++ | 61% | 37% |
| 106-3A | Specific modification (2'-deoxy-2'-fluoro)<br>5-UUCUAACCGGGCAGCUUCUTT<br>(SEQ ID NO: 771)<br>TTAAGAUUGGCCCGUCGAAGA-5<br>(SEQ ID NO: 772) | +++ | 71% | 5% |
| 106-3B | Specific modification (2'-deoxy-2'-fluoro)<br>5-UUCUAACCGGGCAGCUUCUTT<br>(SEQ ID NO: 773)<br>TTAAGAUUGGCCCGUCGAAGA-5<br>(SEQ ID NO: 774) | +++ | 72% | 1% |

TABLE 107

| gene | mice(NM_008960.2) (SEQ ID NO: 19) SIRNA | Locus Stability | 920-938 BP Expression inhibition ratio | Growth inhibition ratio |
|---|---|---|---|---|
| 107-1 | Unmodified siRNA<br>5-GAGGAUGGAUUCGACUUAGTT<br>(SEQ ID NO: 775)<br>TTCUCCUACCUAAGCUGAAUC-5<br>(SEQ ID NO: 776) | + | 95% | 0% |
| 107-2 | Random modification (2'-O-methyl)<br>5-GAGGAUGGAUUCGACUUAGTT<br>(SEQ ID NO: 777)<br>TTCUCCUACCUAAGCUGAAUC-5<br>(SEQ ID NO: 778) | ++ | 23% | 22% |
| 107-3A | Specific modification (2'-O-methyl)<br>5-GAGGAUGGAUUCGACUUAGTT<br>(SEQ ID NO: 779)<br>TTCUCCUACCUAAGCUGAAUC-5<br>(SEQ ID NO: 780) | ++ | 91% | 6% |

TABLE 107-continued

| gene | mice(NM_008960.2) (SEQ ID NO: 19) SIRNA | Locus Stability | 920-938 BP Expression inhibition ratio | Growth inhibition ratio |
|---|---|---|---|---|
| 107-3B | Specific modification (2'-O-methyl)<br>5-GAGGAUGGAUUCGACUUAGTT<br>(SEQ ID NO: 775)<br>TTCUCCUACCUAAGCUGAAUC-5<br>(SEQ ID NO: 781) | ++ | 94% | 0% |

TABLE 108

| gene | mice(NM_008960.2) (SEQ ID NO: 19) SIRNA | Locus Stability | 1240-1258 BP Expression inhibition ratio | Growth inhibition ratio |
|---|---|---|---|---|
| 108-1 | Unmodified siRNA<br>5-UAAAGCUGGAAAGGGACGGTT<br>(SEQ ID NO: 782)<br>TTAUUUCGACCUUUCCCUGCC-5<br>(SEQ ID NO: 783) | + | 67% | 0% |
| 108-2 | Random modification (2'-O-methyl)<br>5-UAAAGCUGGAAAGGGACGGTT<br>(SEQ ID NO: 784)<br>TTAUUUCGACCUUUCCCUGCC-5<br>(SEQ ID NO: 785) | ++ | 29% | 28% |
| 108-3A | Specific modification (2'-O-methyl)<br>5-UAAAGCUGGAAAGGGACGGTT<br>(SEQ ID NO: 786)<br>TTAUUUCGACCUUUCCCUGCC-5<br>(SEQ ID NO: 787) | ++ | 65% | 4% |
| 108-3B | Specific modification (2'-O-methyl)<br>5-UAAAGCUGGAAAGGGACGGTT<br>(SEQ ID NO: 788)<br>TTAUUUCGACCUUUCCCUGCC-5<br>(SEQ ID NO: 789) | ++ | 67% | 1% |

TABLE 109

| gene | mice(NM_008960.2) (SEQ ID NO: 19) SIRNA | Locus Stability | 1336-1354 BP Expression inhibition ratio | Growth inhibition ratio |
|---|---|---|---|---|
| 109-1 | Unmodified siRNA<br>5-GGAAGUAAGGACCAGAGACTT<br>(SEQ ID NO: 790)<br>TTCCUUCAUUCCUGGUCUCUG-5<br>(SEQ ID NO: 791) | + | 45% | 0% |
| 109-2 | Random modification (2'-O-methyl)<br>5-GGAAGUAAGGACCAGAGACTT<br>(SEQ ID NO: 792)<br>TTCCUUCAUUCCUGGUCUCUG-5<br>(SEQ ID NO: 793) | ++ | 23% | 27% |
| 109-3A | Specific modification (2'-O-methyl)<br>5-GGAAGUAAGGACCAGAGACTT<br>(SEQ ID NO: 794)<br>TTCCUUCAUUCCUGGUCUCUG-5<br>(SEQ ID NO: 795) | ++ | 41% | 4% |
| 109-3B | Specific modification (2'-O-methyl)<br>5-GGAAGUAAGGACCAGAGACTT<br>(SEQ ID NO: 796)<br>TTCCUUCAUUCCUGGUCUCUG-5<br>(SEQ ID NO: 797) | ++ | 44% | 1% |

TABLE 110

| gene | mice(NM_008960.2) (SEQ ID NO: 19) SIRNA | Locus Stability | 1862-1880 BP Expression inhibition ratio | Growth inhibition ratio |
|---|---|---|---|---|
| 110-1 | Unmodified siRNA<br>5-AAGGCCAACCGAUACUUCUTT<br>(SEQ ID NO: 798)<br>TTUUCCGGUUGGCUAUGAAGA-5<br>(SEQ ID NO: 799) | ++ | 70% | 0% |
| 110-2 | Random modification (2'-deoxy-2'-fluoro)<br>5-AAGGCCAACCGAUACUUCUTT<br>(SEQ ID NO: 800)<br>TTUUCCGGUUGGCUAUGAAGA-5<br>(SEQ ID NO: 801) | +++ | 46% | 24% |
| 110-3A | Specific modification (2'-deoxy-2'-fluoro)<br>5-AAGGCCAACCGA<u>UA</u>CUUCUTT<br>(SEQ ID NO: 802)<br>TTUUCCGGUUGGCU<u>AU</u>GAAGA-5<br>(SEQ ID NO: 803) | +++ | 68% | 5% |
| 110-3B | Specific modification (2'-deoxy-2'-fluoro)<br>5-AAGGCCAACCGA<u>U</u>ACUUCUTT<br>(SEQ ID NO: 804)<br>TTUUCCGGUUGGCUA<u>U</u>GAAGA-5<br>(SEQ ID NO: 805) | +++ | 69% | 1% |

TABLE 111

| gene | mice(NM_008960.2) (SEQ ID NO: 19) SIRNA | Locus Stability | 2489-2507 BP Expression inhibition ratio | Growth inhibition ratio |
|---|---|---|---|---|
| 111-1 | Unmodified siRNA<br>5-GUUCACGUCCUACCCCUUUTT<br>(SEQ ID NO: 806)<br>TTCAAGUGCAGGAUGGGGAAA-5<br>(SEQ ID NO: 807) | + | 67% | 0% |
| 111-2 | Random modification (2'-deoxy-2'-fluoro)<br>5-GUUCACGUCCUACCCCUUUTT<br>(SEQ ID NO: 808)<br>TTCAAGUGCAGGAUGGGGAAA-5<br>(SEQ ID NO: 809) | ++ | 23% | 27% |
| 111-3A | Specific modification (2'-deoxy-2'-fluoro)<br>5-GUUCACGUCC<u>UA</u>CCCCUUUTT<br>(SEQ ID NO: 810)<br>TTCAAGUGCAGG<u>AU</u>GGGGAAA-5<br>(SEQ ID NO: 811) | ++ | 65% | 5% |
| 111-3B | Specific modification (2'-deoxy-2'-fluoro)<br>5-GUUCACGUCC<u>UA</u>CCCCUUUTT<br>(SEQ ID NO: 806)<br>TTCAAGUGCAGG<u>A</u>UGGGGAAA-5<br>(SEQ ID NO: 812) | ++ | 69% | 0% |

TABLE 112

| gene | mice(NM_008960.2) (SEQ ID NO: 19) SIRNA | Locus Stability | 3572-3590 BP Expression inhibition ratio | Growth inhibition ratio |
|---|---|---|---|---|
| 112-1 | Unmodified siRNA<br>5-AGAGUUGGGAUUAGGGCUUTT<br>(SEQ ID NO: 813)<br>TTUCUCAACCCUAAUCCCGAA-5<br>(SEQ ID NO: 814) | + | 71% | 0% |

TABLE 112-continued

| | | | 3572-3590 BP | |
|---|---|---|---|---|
| gene | mice(NM_008960.2) (SEQ ID NO: 19) SIRNA | Locus Stability | Expression inhibition ratio | Growth inhibition ratio |
| 112-2 | Random modification (2'-O-methyl) 5-AGAGUUGGGAUUAGGGCUUTT (SEQ ID NO: 815) TTUCUCAACCCUAAUCCCGAA-5 (SEQ ID NO: 816) | ++ | 45% | 19% |
| 112-3A | Specific modification (2'-O-methyl) 5-AGAGUUGGGAUUAGGGCUUTT (SEQ ID NO: 817) TTUCUCAACCCUAAUCCCGAA-5 (SEQ ID NO: 818) | ++ | 68% | 4% |
| 112-3B | Specific modification (2'-O-methyl) 5-AGAGUUGGGAUUAGGGCUUTT (SEQ ID NO: 819) TTUCUCAACCCUAAUCCCGAA-5 (SEQ ID NO: 820) | ++ | 69% | 0% |

TABLE 113

| | | | 3694-3712 BP | |
|---|---|---|---|---|
| gene | mice(NM_008960.2) (SEQ ID NO: 19) SIRNA | Locus Stability | Expression inhibition ratio | Growth inhibition ratio |
| 113-1 | Unmodified siRNA 5-UUACAAAGGAUCUCCUCCCTT (SEQ ID NO: 821) TTAAUGUUUCCUAGAGGAGGG-5 (SEQ ID NO: 822) | + | 81% | 0% |
| 113-2 | Random modification (2'-O-methyl) 5-UUACAAAGGAUCUCCUCCCTT (SEQ ID NO: 823) TTAAUGUUUCCUAGAGGAGGG-5 (SEQ ID NO: 824) | ++ | 57% | 31% |
| 113-3A | Specific modification (2'-O-methyl) 5-UUACAAAGGAUCUCCUCCCTT (SEQ ID NO: 825) TTAAUGUUUCCUAGAGGAGGG-5 (SEQ ID NO: 826) | ++ | 78% | 5% |
| 113-3B | Specific modification (2'-O-methyl) 5-UUACAAAGGAUCUCCUCCCTT (SEQ ID NO: 827) TTAAUGUUUCCUAGAGGAGGG-5 (SEQ ID NO: 828) | ++ | 69% | 1% |

TABLE 114

| | | | 5159-5177 BP | |
|---|---|---|---|---|
| gene | mice(NM_008960.2) (SEQ ID NO: 19) SIRNA | Locus Stability | Expression inhibition ratio | Growth inhibition ratio |
| 114-1 | Unmodified siRNA 5-AACAGCCUUACCCCGAUUCTT (SEQ ID NO: 829) TTUUGUCGGAAUGGGGCUAAG-5 (SEQ ID NO: 830) | + | 70% | 0% |
| 114-2 | Random modification (2'-O-methyl) 5-AACAGCCUUACCCCGAUUCTT (SEQ ID NO: 831) TTUUGUCGGAAUGGGGCUAAG-5 (SEQ ID NO: 832) | ++ | 32% | 24% |

TABLE 114-continued

| gene | mice(NM_008960.2) (SEQ ID NO: 19) SIRNA | Locus Stability | 5159-5177 BP Expression inhibition ratio | Growth inhibition ratio |
|---|---|---|---|---|
| 114-3A | Specific modification (2'-O-methyl)<br>5-AACAGCCUUACCCCGAUUCTT<br>(SEQ ID NO: 833)<br>TTUUGUCGGAAUGGGGCUAAG-5<br>(SEQ ID NO: 834) | ++ | 68% | 4% |
| 114-3B | Specific modification (2'-O-methyl)<br>5-AACAGCCUUACCCCGAUUCTT<br>(SEQ ID NO: 829)<br>TTUUGUCGGAAUGGGGCUAAG-5<br>(SEQ ID NO: 835) | ++ | 69% | 0% |

TABLE 115

| gene | mice(NM_008960.2) (SEQ ID NO: 19) SIRNA | Locus Stability | 5166-5184 BP Expression inhibition ratio | Growth inhibition ratio |
|---|---|---|---|---|
| 115-1 | Unmodified siRNA<br>5-UUACCCCGAUUCAGCCUCUTT<br>(SEQ ID NO: 836)<br>TTAAUGGGGCUAAGUCGGAGA-5<br>(SEQ ID NO: 837) | + | 84% | 0% |
| 115-2 | Random modification (2'-deoxy-2'-fluoro)<br>5-UUACCCCGAUUCAGCCUCUTT<br>(SEQ ID NO: 838)<br>TTAAUGGGGCUAAGUCGGAGA-5<br>(SEQ ID NO: 837) | ++ | 67% | 24% |
| 115-3A | Specific modification (2'-deoxy-2'-fluoro)<br>5-UUACCCCGAUUCAGCCUCUTT<br>(SEQ ID NO: 839)<br>TTAAUGGGGCUAAGUCGGAGA-5<br>(SEQ ID NO: 840) | ++ | 82% | 3% |
| 115-3B | Specific modification (2'-deoxy-2'-fluoro)<br>5-UUACCCCGAUUCAGCCUCUTT<br>(SEQ ID NO: 841)<br>TTAAUGGGGCUAAGUCGGAGA-5<br>(SEQ ID NO: 842) | ++ | 69% | 1% |

TABLE 116

| gene | mice(NM_008960.2) (SEQ ID NO: 19) SIRNA | Locus Stability | 5695-5713 BP Expression inhibition ratio | Growth inhibition ratio |
|---|---|---|---|---|
| 116-1 | Unmodified siRNA<br>5-UAACCCCAAGAACGGGCUUTT<br>(SEQ ID NO: 843)<br>TTAUUGGGGUUCUUGCCCGAA-5<br>(SEQ ID NO: 844) | + | 75% | 0% |
| 116-2 | Random modification (2'-deoxy-2'-fluoro)<br>5-UAACCCCAAGAACGGGCUUTT<br>(SEQ ID NO: 845)<br>TTAUUGGGGUUCUUGCCCGAA-5<br>(SEQ ID NO: 846) | ++ | 47% | 25% |
| 116-3A | Specific modification (2'-deoxy-2'-fluoro)<br>5-UAACCCCAAGAACGGGCUUTT<br>(SEQ ID NO: 847)<br>TTAUUGGGGUUCUUGCCCGAA-5<br>(SEQ ID NO: 848) | ++ | 72% | 6% |

TABLE 116-continued

| gene | mice(NM_008960.2) (SEQ ID NO: 19) SIRNA | Locus Stability | 5695-5713 BP Expression inhibition ratio | Growth inhibition ratio |
|---|---|---|---|---|
| 116-3B | Specific modification (2'-deoxy-2'-fluoro)<br>5-<u>UA</u>ACCCCAAGAACGGGCUUTT<br>(SEQ ID NO: 849)<br>TT<u>AU</u>UGGGGUUCUUGCCCGAA-5<br>(SEQ ID NO: 850) | ++ | 73% | 1% |

TABLE 117

| gene | aspergillus AF293 protein(XM_748400)<br>(SEQ ID NO: 851)<br>SIRNA | Locus Stability | 499-517 BP Expression inhibition ratio | Growth inhibition ratio |
|---|---|---|---|---|
| 117-1 | Unmodified siRNA<br>5-CUAGUCGAAAGAAAACGGGTT<br>(SEQ ID NO: 852)<br>TTGAUCAGCUUUCUUUUGCCC-5<br>(SEQ ID NO: 853) | + | 57% | 0% |
| 117-2 | Random modification (2'-O-methyl)<br>5-CUAGUCGAAAGAAAACGGGTT<br>(SEQ ID NO: 854)<br>TTGAUCAGCUUUCUUUUGCCC-5<br>(SEQ ID NO: 855) | ++ | 23% | 19% |
| 117-3A | Specific modification (2'-O-methyl)<br>5-C<u>UA</u>GUCGAAAG<u>AAA</u>ACGGGTT<br>(SEQ ID NO: 856)<br>TTG<u>AU</u>CAGCUUUCUUUUGCCC-5<br>(SEQ ID NO: 857) | ++ | 55% | 6% |
| 117-3B | Specific modification (2'-O-methyl)<br>5-C<u>UA</u>GUCGAAAGAAAACGGGTT<br>(SEQ ID NO: 858)<br>TTG<u>AU</u>CAGCUUUCUUUUGCCC-5<br>(SEQ ID NO: 859) | ++ | 56% | 1% |

TABLE 118

| gene | aspergillus AF293 protein(XM_748400)<br>(SEQ ID NO: 851)<br>SIRNA | Locus Stability | 1214-1232 BP Expression inhibition ratio | Growth inhibition ratio |
|---|---|---|---|---|
| 118-1 | Unmodified siRNA<br>5-AGGACGGUACUUUCGAAAGTT<br>(SEQ ID NO: 860)<br>TTCCUGCCAUGAAAGCUUUC-5<br>(SEQ ID NO: 861) | + | 46% | 0% |
| 118-2 | Random modification (2'-O-methyl)<br>5-AGGACGGUACUUUCGAAAGTT<br>(SEQ ID NO: 862)<br>TTCCUGCCAUGAAAGCUUUC-5<br>(SEQ ID NO: 863) | ++ | 17% | 51% |
| 118-3A | Specific modification (2'-O-methyl)<br>5-AGGACGG<u>UA</u>CUUUCG<u>AAA</u>GTT<br>(SEQ ID NO: 864)<br>TTCCUGCC<u>AU</u>GAAAGCUUUC-5<br>(SEQ ID NO: 865) | ++ | 44% | 6% |
| 118-3B | Specific modification (2'-O-methyl)<br>5-AGGACGG<u>UA</u>CUUUCGAAAGTT<br>(SEQ ID NO: 860)<br>TTCCUGCC<u>AU</u>GAAAGCUUUC-5<br>(SEQ ID NO: 866) | ++ | 46% | 0% |

TABLE 119

| gene | *Aspergillus* AF293 protein XM_748400)<br>(SEQ ID NO: 851)<br>SIRNA | Locus<br>Stability | 1234-1252 BP | |
|---|---|---|---|---|
| | | | Expression<br>inhibition ratio | Growth inhibition ratio |
| 119-1 | Unmodified siRNA<br>5-GUAUCCGAAGACGAAGCUATT<br>(SEQ ID NO: 867)<br>TTCAUAGGCUUCUGCUUCGAU-5<br>(SEQ ID NO: 868) | + | 97% | 0% |
| 119-2 | Random modification (2'-O-methyl)<br>5-GUAUCCGAAGACGAAGCUATT<br>(SEQ ID NO: 869)<br>TTCAUAGGCUUCUGCUUCGAU-5<br>(SEQ ID NO: 870) | +++ | 30% | 31% |
| 119-3A | Specific modification (2'-O-methyl)<br>5-G<u>U</u>AUCCGAAGACGAAGC<u>U</u>ATT<br>(SEQ ID NO: 871)<br>TTC<u>A</u>UAGGCUUCUGCUUCG<u>AU</u>-5<br>(SEQ ID NO: 872) | +++ | 92% | 8% |
| 119-3B | Specific modification (2'-O-methyl)<br>5-GUAUCCGAAGACGAAGC<u>U</u>ATT<br>(SEQ ID NO: 873)<br>TTC<u>A</u>UAGGCUUCUGCUUCG<u>AU</u>-5<br>(SEQ ID NO: 874) | +++ | 95% | 1% |

TABLE 120

| gene | *Aspergillus* AF293 protein(XM_748400)<br>(SEQ ID NO: 851)<br>SIRNA | Locus<br>Stability | 14-32 BP | |
|---|---|---|---|---|
| | | | Expression<br>inhibition ratio | Growth inhibition ratio |
| 120-1 | Unmodified siRNA<br>5-AGAGAGGUGGAGGUAUCUCTT<br>(SEQ ID NO: 875)<br>TTUCUCUCCACCUCCAUAGAG-5<br>(SEQ ID NO: 876) | + | 91% | 0% |
| 120-2 | Random modification (2'-O-methyl)<br>5-AGAGAGGUGGAGGUAUCUCTT<br>(SEQ ID NO: 877)<br>TTUCUCUCCACCUCCAUAGAG-5<br>(SEQ ID NO: 878) | ++ | 67% | 24% |
| 120-3A | Specific modification (2'-O-methyl)<br>5-AGAGAGGUGGAGG<u>U</u>AUCUCTT<br>(SEQ ID NO: 879)<br>TTUCUCUCCACCUCC<u>AU</u>AGAG-5<br>(SEQ ID NO: 880) | ++ | 87% | 8% |
| 120-3B | Specific modification (2'-O-methyl)<br>5-AGAGAGGUGGAGG<u>U</u>AUCUCTT<br>(SEQ ID NO: 881)<br>TTUCUCUCCACCUCC<u>AU</u>AGAG-5<br>(SEQ ID NO: 882) | ++ | 90% | 1% |

TABLE 121

| gene | *Aspergillus* AF293 protein XM_748400)<br>(SEQ ID NO: 851)<br>SIRNA | Locus<br>Stability | 103-121 BP | |
|---|---|---|---|---|
| | | | Expression<br>inhibition ratio | Growth inhibition ratio |
| 121-1 | Unmodified siRNA<br>5-GAAAACGCUUGUAAAGCCGTT<br>(SEQ ID NO: 883)<br>TTCUUUUGCGAACAUUUCGGC-5<br>(SEQ ID NO: 884) | + | 58% | 0% |

TABLE 121-continued

| gene | Aspergillus AF293 protein XM_748400)<br>(SEQ ID NO: 851)<br>SIRNA | Locus<br>Stability | 103-121 BP | |
|---|---|---|---|---|
| | | | Expression<br>inhibition ratio | Growth inhibition ratio |
| 121-2 | Random modification (2'-O-methyl)<br>5-GAAAACGCUUGUAAAGCCGTT<br>(SEQ ID NO: 885)<br>TTCUUUUGCGAACAUUUCGGC-5<br>(SEQ ID NO: 886) | ++ | 23% | 24% |
| 121-3A | Specific modification (2'-O-methyl)<br>5-GAAAACGCUUGUAAAGCCGTT<br>(SEQ ID NO: 887)<br>TTCUUUUGCGAACAUUUCGGC-5<br>(SEQ ID NO: 888) | ++ | 54% | 5% |
| 121-3B | Specific modification (2'-O-methyl)<br>5-GAAAACGCUUGUAAAGCCGTT<br>(SEQ ID NO: 883)<br>TTCUUUUGCGAACAUUUCGGC-5<br>(SEQ ID NO: 889) | ++ | 56% | 0% |

TABLE 122

| gene | Aspergillus AF293 protein(XM_748400)<br>(SEQ ID NO: 851)<br>SIRNA | Locus<br>Stability | 493-511 BP | |
|---|---|---|---|---|
| | | | Expression<br>inhibition ratio | Growth<br>inhibition ratio |
| 122-1 | Unmodified siRNA<br>5-GCUGAACUAGUCGAAAGAATT<br>(SEQ ID NO: 890)<br>TTCGACUUGAUCAGCUUUCUU-5<br>(SEQ ID NO: 891) | + | 81% | 0% |
| 122-2 | Random modification (2'-deoxy-2'-fluoro)<br>5-GCUGAACUAGUCGAAAGAATT<br>(SEQ ID NO: 892)<br>TTCGACUUGAUCAGCUUUCUU-5<br>(SEQ ID NO: 893) | ++ | 49% | 29% |
| 122-3A | Specific modification (2'-deoxy-2'-fluoro)<br>5-GCUGAACUAGUCGAAAGAATT<br>(SEQ ID NO: 894)<br>TTCGACUUGAUCAGCUUUCUU-5<br>(SEQ ID NO: 895) | ++ | 78% | 3% |
| 122-3B | Specific modification (2'-deoxy-2'-fluoro)<br>5-GCUGAACUAGUCGAAAGAATT<br>(SEQ ID NO: 896)<br>TTCGACUUGAUCAGCUUUCUU-5<br>(SEQ ID NO: 897) | ++ | 79% | 1% |

TABLE 123

| gene | Aspergillus AF293 protein(XM_748400)<br>(SEQ ID NO: 851)<br>SIRNA | Locus<br>Stability | 537-555 BP | |
|---|---|---|---|---|
| | | | Expression<br>inhibition ratio | Growth<br>inhibition ratio |
| 123-1 | Unmodified siRNA<br>5-GGAAGAAGAUAGAGCAUCCTT<br>(SEQ ID NO: 898)<br>TTCCUUCUUCUAUCUCGUAGG-5<br>(SEQ ID NO: 899) | + | 38% | 0% |
| 123-2 | Random modification (2'-deoxy-2'-fluoro)<br>5-GGAAGAAGAUAGAGCAUCCTT<br>(SEQ ID NO: 900)<br>TTCCUUCUUCUAUCUCGUAGG-5<br>(SEQ ID NO: 901) | ++ | 13% | 19 |

TABLE 123-continued

| | Aspergillus AF293 protein(XM_748400) | | 537-555 BP | |
| gene | (SEQ ID NO: 851) SIRNA | Locus Stability | Expression inhibition ratio | Growth inhibition ratio |
|---|---|---|---|---|
| 123-3A | Specific modification (2'-deoxy-2'-fluoro)<br>5-GGAAGAAGAUAGAGCAUCCTT<br>(SEQ ID NO: 902)<br>TTCCUUCUUCUAUCUCGUAGG-5<br>(SEQ ID NO: 903) | ++ | 37% | 4% |
| 123-3B | Specific modification (2'-deoxy-2'-fluoro)<br>5-GGAAGAAGAUAGAGCAUCCTT<br>(SEQ ID NO: 898)<br>TTCCUUCUUCUAUCUCGUAGG-5<br>(SEQ ID NO: 904) | ++ | 37% | 0% |

TABLE 124

| | Aspergillus AF293 protein XM_748400) | | 623-641 BP | |
| gene | (SEQ ID NO: 851) SIRNA | Locus Stability | Expression inhibition ratio | Growth inhibition ratio |
|---|---|---|---|---|
| 124-1 | Unmodified siRNA<br>5-AUCUACCCAGCUCUCCCUUTT<br>(SEQ ID NO: 905)<br>TTUAGAUGGGUCGAGAGGGAA-5<br>(SEQ ID NO: 906) | + | 79% | 0% |
| 124-2 | Random modification (2'-O-methyl)<br>5-AUCUACCCAGCUCUCCCUUTT<br>(SEQ ID NO: 907)<br>TTUAGAUGGGUCGAGAGGGAA-5<br>(SEQ ID NO: 908) | ++ | 43% | 21% |
| 124-3A | Specific modification (2'-O-methyl)<br>5-AUCUACCCAGCUCUCCCUUTT<br>(SEQ ID NO: 909)<br>TTUAGAUGGGUCGAGAGGGAA-5<br>(SEQ ID NO: 910) | ++ | 75% | 6% |
| 124-3B | Specific modification (2'-O-methyl)<br>5-AUCUACCCAGCUCUCCCUUTT<br>(SEQ ID NO: 911)<br>TTUAGAUGGGUCGAGAGGGAA-5<br>(SEQ ID NO: 912) | ++ | 77% | 1% |

TABLE 125

| | Aspergillus AF293 protein(XM_748400) | | 1096-1114 BP | |
| gene | (SEQ ID NO: 851) SIRNA | Locus Stability | Expression inhibition ratio | Growth inhibition ratio |
|---|---|---|---|---|
| 125-1 | Unmodified siRNA<br>5-AGCGAUCCCGAACAAGUAUTT<br>(SEQ ID NO: 913)<br>TTUCGCUAGGGCUUGUUCAUA-5<br>(SEQ ID NO: 914) | + | 87% | 0% |
| 125-2 | Random modification (2'-O-methyl)<br>5-AGCGAUCCCGAACAAGUAUTT<br>(SEQ ID NO: 915)<br>TTUCGCUAGGGCUUGUUCAUA-5<br>(SEQ ID NO: 916) | ++ | 34% | 25% |
| 125-3A | Specific modification (2'-O-methyl)<br>5-AGCGAUCCCGAACAAGUAUTT<br>(SEQ ID NO: 917)<br>TTCGCUAGGGCUUGUUCAUA-5<br>(SEQ ID NO: 918) | ++ | 84% | 4% |

TABLE 125-continued

| | Aspergillus AF293 protein(XM_748400)<br>(SEQ ID NO: 851) | Locus | 1096-1114 BP | |
|---|---|---|---|---|
| gene | SIRNA | Stability | Expression inhibition ratio | Growth inhibition ratio |
| 125-3B | Specific modification (2'-O-methyl)<br>5-AGCGAUCCCGAACAAGUAUTT<br>(SEQ ID NO: 913)<br>TTUCGCUAGGGCUUGUUCAUA-5<br>(SEQ ID NO: 919) | ++ | 85% | 0% |

TABLE 126

| | Aspergillus AF293 protein(XM_748400)<br>(SEQ ID NO: 851) | Locus | 1227-1245 BP | |
|---|---|---|---|---|
| gene | SIRNA | Stability | Expression inhibition ratio | Growth inhibition ratio |
| 126-1 | Unmodified siRNA<br>5-CGAAAGUGUAUCCGAAGACTT<br>(SEQ ID NO: 920)<br>TTGCUUUCACAUAGGCUUCUG-5<br>(SEQ ID NO: 921) | + | 77% | 0% |
| 126-2 | Random modification (2'-deoxy-2'-fluoro)<br>5-CGAAAGUGUAUCCGAAGACTT<br>(SEQ ID NO: 922)<br>TTGCUUUCACAUAGGCUUCUG-5<br>(SEQ ID NO: 923) | ++ | 41% | 22% |
| 126-3A | Specific modification (2'-deoxy-2'-fluoro)<br>5-CGAAAGUGUAUCCGAAGACTT<br>(SEQ ID NO: 924)<br>TTGCUUUCACAUAGGCUUCUG-5<br>(SEQ ID NO: 925) | ++ | 75% | 3% |
| 126-3B | Specific modification (2'-deoxy-2'-fluoro)<br>5-CGAAAGUGUAUCCGAAGACTT<br>(SEQ ID NO: 920)<br>TTGCUUUCACAUAGGCUUCUG-5<br>(SEQ ID NO: 926) | ++ | 69% | 0% |

TABLE 127

| | Aspergillus AF293 protein(XM_748400)<br>(SEQ ID NO: 851) | Locus | 1238-1256 BP | |
|---|---|---|---|---|
| gene | SIRNA | Stability | Expression inhibition ratio | Growth inhibition ratio |
| 127-1 | Unmodified siRNA<br>5-CCGAAGACGAAGCUAUGAATT<br>(SEQ ID NO: 927)<br>TTGGCUUCUGCUUCGAUACUU-5<br>(SEQ ID NO: 928) | + | 48% | 0% |
| 127-2 | Random modification (2'-deoxy-2'-fluoro)<br>5-CCGAAGACGAAGCUAUGAATT<br>(SEQ ID NO: 929)<br>TTGGCUUCUGCUUCGAUACUU-5<br>(SEQ ID NO: 930) | ++ | 23% | 19% |
| 127-3A | Specific modification (2'-deoxy-2'-fluoro)<br>5-CCGAAGACGAAGCUAUGAATT<br>(SEQ ID NO: 931)<br>TTGGCUUCUGCUUCGAUACUU-5<br>(SEQ ID NO: 932) | ++ | 46% | 2% |
| 127-3B | Specific modification (2'-deoxy-2'-fluoro)<br>5-CCGAAGACGAAGCUAUGAATT<br>(SEQ ID NO: 927)<br>TTGGCUUCUGCUUCGAUACUU-5<br>(SEQ ID NO: 933) | ++ | 47% | 0% |

TABLE 128

| gene | Human BIC(NR_001458.3) (SEQ ID NO: 40) SIRNA | Locus Stability | 170-188 BP Expression inhibition ratio | Growth inhibition ratio |
|---|---|---|---|---|
| 128-1 | Unmodified siRNA<br>5-UCUCCCACCCAAUGGAGAU<br>(SEQ ID NO: 934)<br>TTAGAGGGUGGGUUACCUCUA-5<br>(SEQ ID NO: 935) | + | 83% | 0% |
| 128-2 | Random modification (2'-O-methyl)<br>5-UCUCCCACCCAAUGGAGAU<br>(SEQ ID NO: 936)<br>TTAGAGGGUGGGUUACCUCUA-5<br>(SEQ ID NO: 937) | ++ | 49% | 24% |
| 128-3A | Specific modification (2'-O-methyl)<br>5-UCUCCCACCCAAUGGAGAU<br>(SEQ ID NO: 938)<br>TTAGAGGGUGGGUUACCUCUA-5<br>(SEQ ID NO: 939) | ++ | 78% | 9% |
| 128-3B | Specific modification (2'-O-methyl)<br>5-UCUCCCACCCAAUGGAGAU<br>(SEQ ID NO: 940)<br>TTAGAGGGUGGGUUACCUCUA-5<br>(SEQ ID NO: 935) | ++ | 81% | 4% |

TABLE 129

| gene | Human BIC(NR_001458.3) (SEQ ID NO: 40) SIRNA | Locus Stability | 206-224 BP Expression inhibition ratio | Growth inhibition ratio |
|---|---|---|---|---|
| 129-1 | Unmodified siRNA<br>5-AAACCAGGAAGGGGAAAUCTT<br>(SEQ ID NO: 941)<br>TTUUUGGUCCUUCCCCUUUAG-5<br>(SEQ ID NO: 942) | + | 69% | 0% |
| 129-2 | Random modification (2'-deoxy-2'-fluoro)<br>5-AAACCAGGAAGGGGAAAUCTT<br>(SEQ ID NO: 943)<br>TTUUUGGUCCUUCCCCUUUAG-5<br>(SEQ ID NO: 944) | ++ | 42% | 41% |
| 129-3A | Specific modification (2'-deoxy-2'-fluoro)<br>5-AAACCAGGAAGGGGAAAUCTT<br>(SEQ ID NO: 945)<br>TTUUUGGUCCUUCCCCUUUAG-5<br>(SEQ ID NO: 946) | ++ | 61% | 9% |
| 129-3B | Specific modification (2'-deoxy-2'-fluoro)<br>5-AAACCAGGAAGGGGAAAUCTT<br>(SEQ ID NO: 947)<br>TTUUUGGUCCUUCCCCUUUAG-5<br>(SEQ ID NO: 942) | ++ | 64% | 3% |

TABLE 130

| gene | Human BIC(NR_001458.3) (SEQ ID NO: 40) SIRNA | Locus Stability | 213-231 BP Expression inhibition ratio | Growth inhibition ratio |
|---|---|---|---|---|
| 130-1 | Unmodified siRNA<br>5-GAAGGGGAAAUCUGUGGUUT<br>(SEQ ID NO: 948)<br>TTCUUCCCCUUUAGACACCAA-5<br>(SEQ ID NO: 949) | + | 66% | 0% |

TABLE 130-continued

|  |  |  | 213-231 BP | |
|---|---|---|---|---|
| gene | Human BIC(NR_001458.3) (SEQ ID NO: 40) SIRNA | Locus Stability | Expression inhibition ratio | Growth inhibition ratio |
| 130-2 | Random modification (2'-O-methyl)<br>5-GAAGGGGAAAUCUGUGGUUTT<br>(SEQ ID NO: 950)<br>TTCUUCCCCUUUAGACACCAA-5<br>(SEQ ID NO: 949) | +++ | 41% | 24% |
| 130-3A | Specific modification (2'-O-methyl)<br>5-GAAGGGGAAAUCUGUGGUUTT<br>(SEQ ID NO: 951)<br>TTCUUCCCCUUUAGACACCAA-5<br>(SEQ ID NO: 952) | +++ | 61% | 6% |
| 130-3B | Specific modification (2'-O-methyl)<br>5-GAAGGGGAAAUCUGUGGUUTT<br>(SEQ ID NO: 953)<br>TTCUUCCCCUUUAGACACCAA-5<br>(SEQ ID NO: 954) | +++ | 65% | 2% |

TABLE 131

|  |  |  | 398-416 BP | |
|---|---|---|---|---|
| gene | Human BIC(NR_001458.3) (SEQ ID NO: 40) SIRNA | Locus Stability | Expression inhibition ratio | Growth inhibition ratio |
| 131-1 | Unmodified siRNA<br>5-GGGAGGAUGACAAAGAAGCTT<br>(SEQ ID NO: 955)<br>TTCCCUCCUACUGUUUCUUCG-5<br>(SEQ ID NO: 956) | + | 86% | 0% |
| 131-2 | Random modification (2'-deoxy-2'-fluoro)<br>5-GGGAGGAUGACAAAGAAGCTT<br>(SEQ ID NO: 955)<br>TTCCCUCCUACUGUUUCUUCG-5<br>(SEQ ID NO: 957) | ++ | 37% | 19% |
| 131-3A | Specific modification (2'-deoxy-2'-fluoro)<br>5-GGGAGGAUGACAAAGAAGCTT<br>(SEQ ID NO: 958)<br>TTCCCUCCUACUGUUUCUUCG-5<br>(SEQ ID NO: 959) | ++ | 78% | 9% |
| 131-3B | Specific modification (2'-deoxy-2'-fluoro)<br>5-GGGAGGAUGACAAAGAAGCTT<br>(SEQ ID NO: 960)<br>TTCCCUCCUACUGUUUCUUCG-5<br>(SEQ ID NO: 961) | ++ | 84% | 2% |

TABLE 132

|  |  |  | 170-188 BP | |
|---|---|---|---|---|
| gene | Human BIC(NR_001458.3) (SEQ ID NO: 40) SIRNA | Locus Stability | Expression inhibition ratio | Growth inhibition ratio |
| 132-1 | Unmodified siRNA<br>5-GAAACUGGUACUUUCCCCTT<br>(SEQ ID NO: 962)<br>TTCUUUGACCAUGAAAGGGGG-5<br>(SEQ ID NO: 963) | + | 90% | 0% |
| 132-2 | Random modification (2'-O-methyl)<br>5-GAAACUGGUACUUUCCCCTT<br>(SEQ ID NO: 964)<br>TTCUUUGACCAUGAAAGGGGG-5<br>(SEQ ID NO: 963) | ++ | 57% | 24% |

TABLE 132-continued

| gene | Human BIC(NR_001458.3) (SEQ ID NO: 40) SIRNA | Locus Stability | 170-188 BP Expression inhibition ratio | Growth inhibition ratio |
|---|---|---|---|---|
| 132-3A | Specific modification (2'-O-methyl)<br>5-GAAAUGGUACUUUCCCCTT<br>(SEQ ID NO: 965)<br>TTCUUUGACCAUGAAAGGGGG-5<br>(SEQ ID NO: 966) | ++ | 85% | 7% |
| 132-3B | Specific modification (2'-O-methyl)<br>5-GAAACUGGUACUUUCCCCTT<br>(SEQ ID NO: 967)<br>TTCUUUGACCAUGAAAGGGGG-5<br>(SEQ ID NO: 968) | ++ | 88% | 3% |

TABLE 133

| gene | Human KAZRIN(NM_201628) (SEQ ID NO: 1) SIRNA | Locus Stability | 13-31 BP Expression inhibition ratio | Growth inhibition ratio |
|---|---|---|---|---|
| 133-1 | Unmodified siRNA<br>5-AUCGCUGCUCCUCCUCCUCUTT<br>(SEQ ID NO: 960)<br>TTUAGCGACGAGGAGGAGGAG-5<br>(SEQ ID NO: 970) | + | 72% | 0% |
| 133-2 | Random modification (2'-deoxy-2'-fluoro)<br>5-AUCGCUGCUCCUCCUCCUCUTT<br>(SEQ ID NO: 971)<br>TTUAGCGACGAGGAGGAGGAG-5<br>(SEQ ID NO: 1352) | ++ | 39% | 24% |
| 133-3A | Specific modification (2'-deoxy-2'-fluoro)<br>5-AUCGCUGCUCCUCCUCUTT<br>(SEQ ID NO: 972)<br>TTUAGCGACGAGGAGGAGGAG-5<br>(SEQ ID NO: 973) | ++ | 69% | 6% |
| 133-3B | Specific modification (2'-deoxy-2'-fluoro)<br>5-AUCGCUGCUCCUCCUCUTT<br>(SEQ ID NO: 974)<br>TTUAGCGACGAGGAGGAGGAG-5<br>(SEQ ID NO: 975) | ++ | 71% | 1% |

TABLE 134

| gene | Human KAZRIN(NM_201628) (SEQ ID NO: 1) SIRNA | Locus Stability | 239-257 BP Expression inhibition ratio | Growth inhibition ratio |
|---|---|---|---|---|
| 134-1 | Unmodified siRNA<br>5-AGCUCUUUGUCACCUCUCUTT<br>(SEQ ID NO: 976)<br>TTUCGAGAAACAGUGGAGAGA-5<br>(SEQ ID NO: 977) | + | 39% | 0% |
| 134-2 | Random modification (2'-O-methyl)<br>5-AGCUCUUUGUCACCUCUCUTT<br>(SEQ ID NO: 978)<br>TTUCGAGAAACAGUGGAGAGA-5<br>(SEQ ID NO: 979) | ++ | 19% | 24% |
| 134-3A | Specific modification (2'-O-methyl)<br>5-AGCUCUUUGUCACCUCUCUTT<br>(SEQ ID NO: 980)<br>TTUCGAGAAACAGUGGAGAGA-5<br>(SEQ ID NO: 981) | ++ | 34% | 9% |

TABLE 134-continued

| gene | Human KAZRIN(NM_201628) (SEQ ID NO: 1) SIRNA | Locus Stability | 239-257 BP Expression inhibition ratio | Growth inhibition ratio |
|---|---|---|---|---|
| 134-3B | Specific modification (2'-O-methyl)<br>5-AGCUCUUUGUCACCUCUCUTT<br>(SEQ ID NO: 982)<br>TTUCGAGAAAACAGUGGAGAGA-5<br>(SEQ ID NO: 983) | ++ | 37% | 3% |

TABLE 135

| gene | Human KAZRIN(NM_201628) (SEQ ID NO: 1) SIRNA | Locus Stability | 294-312 BP Expression inhibition ratio | Growth inhibition ratio |
|---|---|---|---|---|
| 135-1 | Unmodified siRNA<br>5-AAUAAGCAGCUCGCGCUCCTT<br>(SEQ ID NO: 984)<br>TTUUAUUCGUCGAGCGCGAGG-5<br>(SEQ ID NO: 985) | + | 58% | 0% |
| 135-2 | Random modification (2'-O-methyl)<br>5-AAUAAGCAGCUCGCGCUCCTT<br>(SEQ ID NO: 986)<br>TTUUAUUCGUCGAGCGCGAGG-5<br>(SEQ ID NO: 987) | ++ | 32% | 24% |
| 135-3A | Specific modification (2'-O-methyl)<br>5-AAUAAGCAGCUCGCGCUCCTT<br>(SEQ ID NO: 988)<br>TTUUAUUCGUCGAGCGCGAGG-5<br>(SEQ ID NO: 989) | ++ | 51% | 9% |
| 135-3B | Specific modification (2'-O-methyl)<br>5-AAUAAGCAGCUCGCGCUCCTT<br>(SEQ ID NO: 990)<br>TTUUAUUCGUCGAGCGCGAGG-5<br>(SEQ ID NO: 991) | ++ | 54% | 2% |

TABLE 136

| gene | Human KAZRIN(NM_201628) (SEQ ID NO: 1) SIRNA | Locus Stability | 1383-1401 BP Expression inhibition ratio | Growth inhibition ratio |
|---|---|---|---|---|
| 136-1 | Unmodified siRNA<br>5-CUAGAGGAUCUUGAAGACCTT<br>(SEQ ID NO: 992)<br>TTGAUCUCCUAGAACUUCUGG-5<br>(SEQ ID NO: 993) | + | 97% | 0% |
| 136-2 | Random modification (2'-deoxy-2'-fluoro)<br>5-CUAGAGGAUCUUGAAGACCTT<br>(SEQ ID NO: 994)<br>TTGAUCUCCUAGAACUUCUGG-5<br>(SEQ ID NO: 995) | ++ | 38% | 29% |
| 136-3A | Specific modification (2'-deoxy-2'-fluoro)<br>5-CUAGAGGAUCUUGAAGACCTT<br>(SEQ ID NO: 996)<br>TTGAUCUCCUAGAACUUCUGG-5<br>(SEQ ID NO: 997) | ++ | 91% | 5% |
| 136-3B | Specific modification (2'-deoxy-2'-fluoro)<br>5-CUAGAGGAUCUUGAAGACCTT<br>(SEQ ID NO: 992)<br>TTGAUCUCCUAGAACUUCUGG-5<br>(SEQ ID NO: 998) | ++ | 95% | 1% |

TABLE 137

| gene | Human KAZRIN(NM_201628) (SEQ ID NO: 1) SIRNA | Locus Stability | 2151-2169 BP | |
|---|---|---|---|---|
| | | | Expression inhibition ratio | Growth inhibition ratio |
| 137-1 | Unmodified siRNA<br>5-AUCGACCUGAAGGAGUACGTT<br>(SEQ ID NO: 999)<br>TTUAGCUGGACUUCCUCAUGC-5<br>(SEQ ID NO: 1000) | + | 32% | 0% |
| 137-2 | Random modification (2'-O-methyl)<br>5-AUCGACCUGAAGGAGUACGTT<br>(SEQ ID NO: 1001)<br>TTUAGCUGGACUUCCUCAUGC-5<br>(SEQ ID NO: 1002) | ++ | 19% | 24% |
| 137-3A | Specific modification (2'-O-methyl)<br>5-AUCGACCUGAAGGAGUACGTT<br>(SEQ ID NO: 1003)<br>TTUAGCUGGACUUCCUCAUGC-5<br>(SEQ ID NO: 1004) | ++ | 29% | 6% |
| 137-3B | Specific modification (2'-O-methyl)<br>5-AUCGACCUGAAGGAGUACGTT<br>(SEQ ID NO: 1005)<br>TTUAGCUGGACUUCCUCAUGC-5<br>(SEQ ID NO: 1006) | ++ | 30% | 1% |

TABLE 138

| gene | Human CDKN1B(NM_004064) (SEQ ID NO: 217) SIRNA | Locus Stability | 80-98 BP | |
|---|---|---|---|---|
| | | | Expression inhibition ratio | Growth inhibition ratio |
| 138-1 | Unmodified siRNA<br>5-CCCUCCCCUGUCCCCGCUUTT<br>(SEQ ID NO: 1007)<br>TTGGGAGGGGACAGGGGCGAA-5<br>(SEQ ID NO: 1008) | + | 75% | 0% |
| 138-2 | Random modification (2'-deoxy-2'-fluoro)<br>5-CCCUCCCCUGUCCCCGCUUTT<br>(SEQ ID NO: 1009)<br>TTGGGAGGGGACAGGGGCGAA-5<br>(SEQ ID NO: 1010) | ++ | 41% | 34% |
| 138-3A | Specific modification (2'-deoxy-2'-fluoro)<br>5-CCCUCCCCUGUCCCCGCUUTT<br>(SEQ ID NO: 1011)<br>TTGGGAGGGGACAGGGGCGAA-5<br>(SEQ ID NO: 1012) | ++ | 72% | 3% |
| 138-3B | Specific modification (2'-deoxy-2'-fluoro)<br>5-CCCUCCCCUGUCCCCGCUUTT<br>(SEQ ID NO: 1013)<br>TTGGGAGGGGACAGGGGCGAA-5<br>(SEQ ID NO: 1014) | ++ | 73% | 1% |

TABLE 139

| gene | Human CDKN1B(NM_004064) (SEQ ID NO: 217) SIRNA | Locus Stability | 431-449 BP | |
|---|---|---|---|---|
| | | | Expression inhibition ratio | Growth inhibition ratio |
| 139-1 | Unmodified siRNA<br>5-UUUGAUCAGCGGAGACUCGTT<br>(SEQ ID NO: 1014)<br>TTAAACUAGUCGCCUCUGAGC-5<br>(SEQ ID NO: 1015) | + | 94% | 0% |

TABLE 139-continued

|  |  |  | 431-449 BP | | |
| --- | --- | --- | --- | --- | --- |
| gene | Human CDKN1B(NM_004064) (SEQ ID NO: 217) SIRNA | Locus Stability | Expression inhibition ratio | Growth inhibition ratio | |
| 139-2 | Random modification (2'-O-methyl)<br>5-UUUGAUCAGCGGAGACUCGTT<br>(SEQ ID NO: 1016)<br>TTAAACUAGUCGCCUCUGAGC-5<br>(SEQ ID NO: 1017) | ++ | 49% | 31% | |
| 139-3A | Specific modification (2'-O-methyl)<br>5-UUUGAUCAGCGGAGACUCGTT<br>(SEQ ID NO: 1018)<br>TTAAACUAGUCGCCUCUGAGC-5<br>(SEQ ID NO: 1019) | ++ | 89% | 3% | |
| 139-3B | Specific modification (2'-O-methyl)<br>5-UUUGAUCAGCGGAGACUCGTT<br>(SEQ ID NO: 1020)<br>TTAAACUAGUCGCCUCUGAGC-5<br>(SEQ ID NO: 1015) | ++ | 82% | 0.5% | |

TABLE 140

|  |  |  | 591-609 BP | | |
| --- | --- | --- | --- | --- | --- |
| gene | Human CDKN1B(NM_004064) (SEQ ID NO: 217) SIRNA | Locus Stability | Expression inhibition ratio | Growth inhibition ratio | |
| 140-1 | Unmodified siRNA<br>5-AGUUAACCCGGGACUUGGATT<br>(SEQ ID NO: 1021)<br>TTCAAUUGGGCCCUGAACCU-5<br>(SEQ ID NO: 1022) | + | 93% | 0% | |
| 140-2 | Random modification (2'-O-methyl)<br>5-AGUUAACCCGGGACUUGGATT<br>(SEQ ID NO: 1023)<br>TTCAAUUGGGCCCUGAACCU-5<br>(SEQ ID NO: 1024) | ++ | 45% | 34% | |
| 140-3A | Specific modification (2'-O-methyl)<br>5-AGUUAACCCGGGACUUGGATT<br>(SEQ ID NO: 1025)<br>TTCAAUUGGGCCCUGAACCU-5<br>(SEQ ID NO: 1026) | ++ | 90% | 3% | |
| 140-3B | Specific modification (2'-O-methyl)<br>5-AGUUAACCCGGGACUUGGATT<br>(SEQ ID NO: 1027)<br>TTCAAUUGGGCCCUGAACCU-5<br>(SEQ ID NO: 1028) | ++ | 91% | 1% | |

TABLE 141

|  |  |  | 669-687 BP | | |
| --- | --- | --- | --- | --- | --- |
| gene | Human CDKN1B(NM_004064) (SEQ ID NO: 217) SIRNA | Locus Stability | Expression inhibition ratio | Growth inhibition ratio | |
| 141-1 | Unmodified siRNA<br>5-AUCACAAACCCCUAGAGGGTT<br>(SEQ ID NO: 1029)<br>TTUAGUGUUUGGGGAUCUCCC-5<br>(SEQ ID NO: 1030) | + | 77% | 0% | |
| 141-2 | Random modification (2'-O-methyl)<br>5-AUCACAAACCCCUAGAGGGTT<br>(SEQ ID NO: 1031)<br>TTAGUGUUUGGGGAUCUCCC-5<br>(SEQ ID NO: 1032) | ++ | 35% | 31% | |

TABLE 141-continued

| gene | Human CDKN1B(NM_004064) (SEQ ID NO: 217) SIRNA | Locus Stability | 669-687 BP Expression inhibition ratio | Growth inhibition ratio |
|---|---|---|---|---|
| 141-3A | Specific modification (2'-O-methyl)<br>5-AU<u>CAC</u>AAACCCC<u>UA</u>GAGGGTT<br>(SEQ ID NO: 1033)<br>TTU<u>AGUGU</u>UUGGGG<u>AU</u>CUCCC-5<br>(SEQ ID NO: 1034) | ++ | 75% | 4% |
| 141-3B | Specific modification (2'-O-methyl)<br>5-AU<u>CAC</u>AAACCCC<u>UA</u>GAGGGTT<br>(SEQ ID NO: 1035)<br>TTU<u>AGUGU</u>UUGGGG<u>AU</u>CUCCC-5<br>(SEQ ID NO: 1036) | ++ | 75% | 1% |

TABLE 142

| gene | Human CDKN1B(NM_004064) (SEQ ID NO: 217) SIRNA | Locus Stability | 674-692 BP Expression inhibition ratio | Growth inhibition ratio |
|---|---|---|---|---|
| 142-1 | Unmodified siRNA<br>5-AAACCCCUAGAGGGCAAGUTT<br>(SEQ ID NO: 1037)<br>TTUUUGGGGAUCUCCCGUUCA-5<br>(SEQ ID NO: 1038) | + | 84% | 0% |
| 142-2 | Random modification (2'-deoxy-2'-fluoro)<br>5-AAACCCCUAGAGGGCAAGUTT<br>(SEQ ID NO: 1029)<br>TT<u>UUUGGGGAUCUCCCGUUCA</u>-5<br>(SEQ ID NO: 1039) | ++ | 37% | 29% |
| 142-3A | Specific modification (2'-deoxy-2'-fluoro)<br>5-AAACCCC<u>UA</u>GAGGG<u>CA</u>AGUTT<br>(SEQ ID NO: 1040)<br>TTUUUGGGG<u>AU</u>CUCCC<u>GU</u>UCA-5<br>(SEQ ID NO: 1041) | ++ | 82% | 5% |
| 142-3B | Specific modification (2'-deoxy-2'-fluoro)<br>5-AAACCCC<u>UA</u>GAGGG<u>CA</u>AGUTT<br>(SEQ ID NO: 1042)<br>TTUUUGGGG<u>AU</u>CUCCC<u>GU</u>UCA-5<br>(SEQ ID NO: 1038) | ++ | 83% | 1% |

TABLE 143

| gene | Chinpanzee SOD2(NM_001009022) (SEQ ID NO: 321) SIRNA | Locus Stability | 45-63 BP Expression inhibition ratio | Growth inhibition ratio |
|---|---|---|---|---|
| 143-1 | Unmodified siRNA<br>5-GGAACCUCACAUCAACGCGCATT<br>(SEQ ID NO: 1043)<br>TTCCUUGGAGUGUAGUUGCGCGU-5<br>(SEQ ID NO: 1044) | + | 70% | 0% |
| 143-2 | Random modification (2'-deoxy-2'-fluoro)<br>5-GGAACCUCACAUCAACGCGCATT<br>(SEQ ID NO: 1045)<br>TTCCUUGGAGUGUAGUUGCGCGU-5<br>(SEQ ID NO: 1046) | ++ | 21% | 43% |
| 143-3A | Specific modification (2'-deoxy-2'-fluoro)<br>5-GGAACCU<u>CACAU</u>CA<u>ACGCG</u>CATT<br>(SEQ ID NO: 1047)<br>TTCCUUGGA<u>GUGUA</u>GUUGCGCG<u>U</u>-5<br>(SEQ ID NO: 1048) | ++ | 52% | 11% |

TABLE 143-continued

| | Chinpanzee SOD2(NM_001009022) | | 45-63 BP | |
|---|---|---|---|---|
| gene | (SEQ ID NO: 321)<br>SIRNA | Locus<br>Stability | Expression<br>inhibition ratio | Growth<br>inhibition ratio |
| 143-3B | Specific modification (2'-deoxy-2'-fluoro)<br>5-GGAACCU<u>CACAUCA</u>ACGCG<u>C</u>ATT<br>(SEQ ID NO: 1049)<br>TTCCUUGGA<u>GUGUAG</u>UUGCGC<u>GU</u>-5<br>(SEQ ID NO: 1050) | ++ | 65% | 4% |

TABLE 144

| | Chinpanzee SOD2(NM_001009022) | | 116-134 BP | |
|---|---|---|---|---|
| gene | (SEQ ID NO: 321)<br>SIRNA | Locus<br>Stability | Expression<br>inhibition ratio | Growth<br>inhibition ratio |
| 144-1 | Unmodified siRNA<br>5-UGAACGUCACCGAGGAGAATT<br>(SEQ ID NO: 1051)<br>TTACUUGCAGUGGCUCCUCUU-5<br>(SEQ ID NO: 1052) | + | 87% | 0% |
| 144-2 | Random modification (2'-O-methyl)<br>5-UGAACGUCACCGAGGAGAATT<br>(SEQ ID NO: 1053)<br>TTACUUGCAGUGGCUCCUCUU-5<br>(SEQ ID NO: 1054) | ++ | 65% | 24% |
| 144-3A | Specific modification (2'-O-methyl)<br>5-<u>UG</u>AACGU<u>CA</u>CCGAGGAGAATT<br>(SEQ ID NO: 1055)<br>TT<u>AC</u>UUGCA<u>GU</u>GGCUCCUCUU-5<br>(SEQ ID NO: 1056) | ++ | 82% | 5% |
| 144-3B | Specific modification (2'-O-methyl)<br>5-<u>UG</u>AACGU<u>CA</u>CCGAGGAGAATT<br>(SEQ ID NO: 1057)<br>TT<u>AC</u>UUGCA<u>G</u>UGGCUCCUCUU-5<br>(SEQ ID NO: 1058) | ++ | 85% | 1% |

TABLE 145

| | Chinpanzee SOD2(NM_001009022) | | 266-284 BP | |
|---|---|---|---|---|
| gene | (SEQ ID NO: 321)<br>SIRNA | Locus<br>Stability | Expression<br>inhibition ratio | Growth<br>inhibition ratio |
| 145-1 | Unmodified siRNA<br>5-AACCCAAAGGGGAGUUGCUTT<br>(SEQ ID NO: 1059)<br>TTUUGGGUUUCCCCUCAACGA-5<br>(SEQ ID NO: 1060) | + | 97% | 0% |
| 145-2 | Random modification (2'-O-methyl)<br>5-AACCCAAGGGGAGUUGCUTT<br>(SEQ ID NO: 1061)<br>TTUUGGGUUUCCCCUCAACGA-5<br>(SEQ ID NO: 1062) | ++ | 37% | 49% |
| 145-3A | Specific modification (2'-O-methyl)<br>5-AACC<u>C</u>AAAGGGGAGU<u>UG</u>CUTT<br>(SEQ ID NO: 1063)<br>TTUUGG<u>GU</u>UUCCCCUCA<u>AC</u>GA-5<br>(SEQ ID NO: 1064) | ++ | 92% | 6% |
| 145-3B | Specific modification (2'-O-methyl)<br>5-AACC<u>C</u>AAAGGGGAGU<u>UG</u>CUTT<br>(SEQ ID NO: 1065)<br>TTUUGG<u>GU</u>UUCCCCUCA<u>AC</u>GA-5<br>(SEQ ID NO: 1066) | ++ | 83% | 1% |

TABLE 146

| gene | Chimpanzee SOD2(NM_001009022)<br>(SEQ ID NO: 321)<br>SIRNA | Locus<br>Stability | 274-292 BP | |
|---|---|---|---|---|
| | | | Expression<br>inhibition ratio | Growth<br>inhibition ratio |
| 146-1 | Unmodified siRNA<br>5-AAAGGGGAGUUGCUGGAAGTT<br>(SEQ ID NO: 1067)<br>TTUUUCCCCUCAACGACCUUC-5<br>(SEQ ID NO: 1068) | + | 77% | 0% |
| 146-2 | Random modification (2'-O-methyl)<br>5-AAAGGGGAGUUGCUGGAAGTT<br>(SEQ ID NO: 1069)<br>TTUUUCCCCUCAACGACCUUC-5<br>(SEQ ID NO: 1070) | ++ | 47% | 31% |
| 146-3A | Specific modification (2'-O-methyl)<br>5-AAAGGGGAGU<u>UG</u>C<u>U</u>GGAAGTT<br>(SEQ ID NO: 1071)<br>TTUUUCCCCUC<u>AA</u>CG<u>AC</u>CUUC-5<br>(SEQ ID NO: 1072) | ++ | 74% | 4% |
| 146-3B | Specific modification (2'-O-methyl)<br>5-AAAGGGGAGU<u>UG</u>CUGGAAGTT<br>(SEQ ID NO: 1073)<br>TTUUUCCCCUC<u>A</u>CG<u>AC</u>CUUC-5<br>(SEQ ID NO: 1074) | ++ | 76% | 1% |

TABLE 147

| gene | Chimpanzee SOD2(NM_001009022)<br>(SEQ ID NO: 321)<br>SIRNA | Locus<br>Stability | 295-313 BP | |
|---|---|---|---|---|
| | | | Expression<br>inhibition ratio | Growth<br>inhibition ratio |
| 147-1 | Unmodified siRNA<br>5-AAACGUGACUUUGGUUCCUTT<br>(SEQ ID NO: 1075)<br>TTUUUGCACUGAAACCAAGGA-5<br>(SEQ ID NO: 1076) | + | 86% | 0% |
| 147-2 | Random modification (2'-O-methyl)<br>5-AAACGUGACUUUGGUUCCUTT<br>(SEQ ID NO: 1077)<br>TTUUUGCACUGAAACCAAGGA-5<br>(SEQ ID NO: 1078) | ++ | 37% | 29% |
| 147-3A | Specific modification (2'-O-methyl)<br>5-AAACG<u>UG</u>ACUU<u>UG</u>GUUC<u>CU</u>TT<br>(SEQ ID NO: 1079)<br>TTUUUGC<u>AC</u>UGAAA<u>CC</u>AAGGA-5<br>(SEQ ID NO: 1080) | ++ | 82% | 5% |
| 147-3B | Specific modification (2'-O-methyl)<br>5-AAACG<u>UG</u>ACUU<u>UG</u>GUUCCUTT<br>(SEQ ID NO: 1081)<br>TTUUUGC<u>AC</u>UGAAA<u>CC</u>AAGGA-5<br>(SEQ ID NO: 1082) | ++ | 83% | 1% |

TABLE 148

| gene | Chimpanzee SOD2(NM_001009022)<br>(SEQ ID NO: 321)<br>SIRNA | Locus<br>Stability | 108-126 BP | |
|---|---|---|---|---|
| | | | Expression<br>inhibition ratio | Growth<br>inhibition ratio |
| 148-1 | Unmodified siRNA<br>5-GAAUAACCUGAACGUCACCTT<br>(SEQ ID NO: 1083)<br>TTCUUAUUGGACUUGCAGUGG-5<br>(SEQ ID NO: 1084) | + | 72% | 0% |

TABLE 148-continued

| | Chimpanzee SOD2(NM_001009022) | | 108-126 BP | |
|---|---|---|---|---|
| gene | (SEQ ID NO: 321)<br>SIRNA | Locus<br>Stability | Expression<br>inhibition ratio | Growth<br>inhibition ratio |
| 148-2 | Random modification (2'-O-methyl)<br>5-GAAUAACCUGAACGUCACCTT<br>(SEQ ID NO: 1085)<br>TTCUUAUUGGACUUGCAGUGG-5<br>(SEQ ID NO: 1086) | ++ | 21% | 19% |
| 148-3A | Specific modification (2'-O-methyl)<br>5-GAAUAACCUGAACGUCACCTT<br>(SEQ ID NO: 1087)<br>TTCUUAUUGGACUUGCAGUGG-5<br>(SEQ ID NO: 1088) | ++ | 69% | 10% |
| 148-3B | Specific modification (2'-O-methyl)<br>5-GAAUAACCUGAACGUCACCTT<br>(SEQ ID NO: 1089)<br>TTCUUAUUGGACUUGCAGUGG-5<br>(SEQ ID NO: 1090) | ++ | 71% | 3% |

TABLE 149

| | Chimpanzee SOD2(NM_001009022) | | 119-137 BP | |
|---|---|---|---|---|
| gene | (SEQ ID NO: 321)<br>SIRNA | Locus<br>Stability | Expression<br>inhibition ratio | Growth<br>inhibition ratio |
| 149-1 | Unmodified siRNA<br>5-ACGUCACCGAGGAGAAGUATT<br>(SEQ ID NO: 1091)<br>TTUGCAGUGGCUCCUCUUCAU-5<br>(SEQ ID NO: 1092) | + | 81% | 0% |
| 149-2 | Random modification (2'-O-methyl)<br>5-ACGUCACCGAGGAGAAGUATT<br>(SEQ ID NO: 1093)<br>TTUGCAGUGGCUCCUCUUCAU-5<br>(SEQ ID NO: 1094) | ++ | 31% | 26% |
| 149-3A | Specific modification (2'-O-methyl)<br>5-ACGUCACCGAGGAGAAGUATT<br>(SEQ ID NO: 1095)<br>TTUGCAGUGGCUCCUCUUCAU-5<br>(SEQ ID NO: 1096) | ++ | 75% | 6% |
| 149-3B | Specific modification (2'-O-methyl)<br>5-ACGUCACCGAGGAGAAGUATT<br>(SEQ ID NO: 1097)<br>TTUGCAGUGGCUCCUCUUCAU-5<br>(SEQ ID NO: 1098) | ++ | 80% | 1% |

TABLE 150

| | Chimpanzee SOD2(NM_001009022) | | 131-149 BP | |
|---|---|---|---|---|
| gene | (SEQ ID NO: 321)<br>SIRNA | Locus<br>Stability | Expression<br>inhibition ratio | Growth<br>inhibition ratio |
| 150-1 | Unmodified siRNA<br>5-AGAAGUACCAGGAGGCGUUTT<br>(SEQ ID NO: 1099)<br>TTUCUUCAUGGUCCUCCGCAA-5<br>(SEQ ID NO: 1100) | + | 62% | 0% |
| 150-2 | Random modification (2'-deoxy-2'-fluoro)<br>5-AGAAGUACCAGGAGGCGUUTT<br>(SEQ ID NO: 1101)<br>TTUCUUCAUGGUCCUCCGCAA-5<br>(SEQ ID NO: 1102) | ++ | 39% | 35% |

TABLE 150-continued

| | Chimpanzee SOD2(NM_001009022) (SEQ ID NO: 321) | | 131-149 BP | |
|---|---|---|---|---|
| gene | SIRNA | Locus Stability | Expression inhibition ratio | Growth inhibition ratio |
| 150-3A | Specific modification (2'-deoxy-2'-fluoro)<br>5-AGAAGUACCAGGAGGCGUUTT<br>(SEQ ID NO: 1103)<br>TTUCUUCAUGGUCCUCCGCAA-5<br>(SEQ ID NO: 1104) | ++ | 57% | 3% |
| 150-3B | Specific modification (2'-deoxy-2'-fluoro)<br>5-AGAAGUACCAGGAGGCGUUTT<br>(SEQ ID NO: 1105)<br>TTUCUUCAUGGUCCUCCGCAA-5<br>(SEQ ID NO: 1106) | ++ | 60% | 1% |

TABLE 151

| | Chimpanzee SOD2(NM_001009022) (SEQ ID NO: 321) | | 240-258 BP | |
|---|---|---|---|---|
| gene | SIRNA | Locus Stability | Expression inhibition ratio | Growth inhibition ratio |
| 151-1 | Unmodified siRNA<br>5-AAACCUCAGCCCUAACGGUTT<br>(SEQ ID NO: 1107)<br>TTUUUGGAGUCGGGAUUGCCA-5<br>(SEQ ID NO: 1108) | + | 71% | 0% |
| 151-2 | Random modification (2'-O-methyl)<br>5-AAACCUCAGCCCUAACGGUTT<br>(SEQ ID NO: 1109)<br>TTUUUGGAGUCGGGAUUGCCA-5<br>(SEQ ID NO: 1110) | ++ | 28% | 27% |
| 151-3A | Specific modification (2'-O-methyl)<br>5-AAACCUCAGCCCUAACGGUTT<br>(SEQ ID NO: 1111)<br>TTUUUGGAGUCGGGAUUGCCA-5<br>(SEQ ID NO: 1112) | ++ | 70% | 3% |
| 151-3B | Specific modification (2'-O-methyl)<br>5-AAACCUCAGCCCUAACGGUTT<br>(SEQ ID NO: 1113)<br>TTUUUGGAGUCGGGAUUGCCA-5<br>(SEQ ID NO: 1114) | ++ | 70% | 1% |

TABLE 152

| | chimpanzee SOD2(NM_001009022) (SEQ ID NO: 321) | | 323-341 BP | |
|---|---|---|---|---|
| gene | SIRNA | Locus Stability | Expression inhibition ratio | Growth inhibition ratio |
| 152-1 | Unmodified siRNA<br>5-UUAAGGAGAAGCUGACGGCTT<br>(SEQ ID NO: 1115)<br>TTAAUUCCUCUUCGACUGCCG-5<br>(SEQ ID NO: 1116) | + | 87% | 0% |
| 152-2 | Random modification (2'-O-methyl)<br>5-UUAAGGAGAAGCUGACGGCTT<br>(SEQ ID NO: 1117)<br>TTAAUUCCUCUUCGACUGCCG-5<br>(SEQ ID NO: 1118) | ++ | 45% | 24% |
| 152-3A | Specific modification (2'-O-methyl)<br>5-UUAAGGAGAAGCUGACGGCTT<br>(SEQ ID NO: 1119)<br>TTAAUUCCUCUUCGACUGCCG-5<br>(SEQ ID NO: 1120) | ++ | 82% | 4% |

TABLE 152-continued

| chimpanzee SOD2(NM_001009022) (SEQ ID NO: 321) | | 323-341 BP | |
|---|---|---|---|
| gene SIRNA | Locus Stability | Expression inhibition ratio | Growth inhibition ratio |
| 152-3B Specific modification (2'-O-methyl)<br>5-UUAUAGGAGAAGCUGACGGCTT<br>(SEQ ID NO: 1121)<br>TTAAUUCCUCUUCGACUGCCG-5<br>(SEQ ID NO: 1122) | ++ | 83% | 1% |

TABLE 153

| rhesus monkey RECEPTOR (XM_001111972) (SEQ ID NO: 383) | | 3-21 BP | |
|---|---|---|---|
| gene SIRNA | Locus Stability | Expression inhibition ratio | Growth inhibition ratio |
| 153-1 Unmodified siRNA<br>5-AACUUCUGGGAGCCUCCAATT<br>(SEQ ID NO: 1123)<br>TTUUGAAGACCCUCGGAGGUU-5<br>(SEQ ID NO: 1124) | + | 75% | 0% |
| 153-2 Random modification (2'-O-methyl)<br>5-AACUUCUGGGAGCCUCCAATT<br>(SEQ ID NO: 1125)<br>TTUUGAAGACCCUCGGAGGUU-5<br>(SEQ ID NO: 1126) | ++ | 42% | 27% |
| 153-3A Specific modification (2'-O-methyl)<br>5-AACUUCUGGGAGCCUCCAATT<br>(SEQ ID NO: 1127)<br>TTUUGAAGACCCUCGGAGGUU-5<br>(SEQ ID NO: 1128) | ++ | 69% | 4% |
| 153-3B Specific modification (2'-O-methyl)<br>5-AACUUCUGGGAGCCUCCAATT<br>(SEQ ID NO: 1129)<br>TTUUGAAGACCCUCGGAGGUU-5<br>(SEQ ID NO: 1130) | ++ | 73% | 1% |

TABLE 154

| Rhesus monkey RECEPTOR(XM_001111972) (SEQ ID NO: 383) | | 80-98 BP | |
|---|---|---|---|
| gene SIRNA | Locus Stability | Expression inhibition ratio | Growth inhibition ratio |
| 154-1 Unmodified siRNA<br>5-CCAGCGAGCCCAAAAGAAATT<br>(SEQ ID NO: 1131)<br>TTGGUCGCUCGGGUUUUCUUU-5<br>(SEQ ID NO: 1132) | + | 87% | 0% |
| 154-2 Random modification (2'-deoxy-2'-fluoro)<br>5-CCAGCGAGCCCAAAAGAAATT<br>(SEQ ID NO: 1133)<br>TTGGUCGCUCGGGUUUUCUUU-5<br>(SEQ ID NO: 1134) | ++ | 35% | 24% |
| 154-3A Specific modification (2'-deoxy-2'-fluoro)<br>5-CCAGCGAGCCCAAAAGAAATT<br>(SEQ ID NO: 1135)<br>TTGGUCGCUCGGGUUUUCUUU-5<br>(SEQ ID NO: 1136) | ++ | 82% | 5% |
| 154-3B Specific modification (2'-deoxy-2'-fluoro)<br>5-CCAGCGAGCCCAAAAGAAATT<br>(SEQ ID NO: 1137)<br>TTGGUCGCUCGGGUUUUCUUU-5<br>(SEQ ID NO: 1132) | ++ | 85% | 1% |

TABLE 155

| gene | Rhesus monkey RECEPTOR (XM_001111972) (SEQ ID NO: 383) SIRNA | Locus Stability | 216-234 BP Expression inhibition ratio | Growth inhibition ratio |
|---|---|---|---|---|
| 155-1 | Unmodified siRNA<br>5-CUCAAAUCAAGGCCGGAGUTT<br>(SEQ ID NO: 1138)<br>TTGAGUUUAGUUCCGGCCUCA-5<br>(SEQ ID NO: 1139) | + | 86% | 0% |
| 155-2 | Random modification (2'-O-methyl)<br>5-CUCAAAUCAAGGCCGGAGUTT<br>(SEQ ID NO: 1140)<br>TTGAGUUUAGUUCCGGCCUCA-5<br>(SEQ ID NO: 1141) | ++ | 36% | 34% |
| 155-3A | Specific modification (2'-O-methyl)<br>5-CU<u>C</u>AAA<u>UC</u>AAGGCCGGAGUTT<br>(SEQ ID NO: 1142)<br>TTGA<u>GU</u>UUA<u>GU</u>UCCGGCCUCA-5<br>(SEQ ID NO: 1143) | ++ | 82% | 4% |
| 155-3B | Specific modification (2'-O-methyl)<br>5-CU<u>C</u>AAAU<u>C</u>AAGGCCGGAGUTT<br>(SEQ ID NO: 1138)<br>TTGA<u>G</u>UUA<u>G</u>UUCCGGCCUCA-5<br>(SEQ ID NO: 1144) | ++ | 85% | 1% |

TABLE 156

| gene | Rhesus monkey RECEPTOR (XM_001111972) (SEQ ID NO: 383) SIRNA | Locus Stability | 13-31 BP Expression inhibition ratio | Growth inhibition ratio |
|---|---|---|---|---|
| 156-1 | Unmodified siRNA<br>5-AGCCUCCAAACUCCUAGCUTT<br>(SEQ ID NO: 1145)<br>TTUCGGAGGUUUGAGGAUCGA-5<br>(SEQ ID NO: 1146) | + | 71% | 0% |
| 156-2 | Random modification (2'-O-methyl)<br>5-AGCCUCCAAACUCCUAGCUTT<br>(SEQ ID NO: 1147)<br>TTUCGGAGGUUUGAGGAUCGA-5<br>(SEQ ID NO: 1148) | ++ | 47% | 19% |
| 156-3A | Specific modification (2'-O-methyl)<br>5-AGCCUC<u>C</u>AAACUCC<u>U</u>AGCUTT<br>(SEQ ID NO: 1149)<br>TTUCGGAG<u>G</u>UUUGAGG<u>AU</u>CGA-5<br>(SEQ ID NO: 1150) | ++ | 65% | 3% |
| 156-3B | Specific modification (2'-O-methyl)<br>5-AGCCUC<u>C</u>AAACUCC<u>U</u>AGCUTT<br>(SEQ ID NO: 1145)<br>TTUCGGAG<u>G</u>UUUGAGG<u>AU</u>CGA-5<br>(SEQ ID NO: 1151) | ++ | 70% | 1% |

TABLE 157

| gene | Rhesus monkey RECEPTOR (XM_001111972) (SEQ ID NO: 383) SIRNA | Locus Stability | 162-180 BP Expression inhibition ratio | Growth inhibition ratio |
|---|---|---|---|---|
| 157-1 | Unmodified siRNA<br>5-AUACUUGGCGGGCUCUUUCTT<br>(SEQ ID NO: 1152)<br>TTUAUGAACCGCCCGAGAAAG-5<br>(SEQ ID NO: 1153) | + | 73% | 0% |

TABLE 157-continued

| gene | Rhesus monkey RECEPTOR (XM_001111972) (SEQ ID NO: 383) SIRNA | Locus Stability | 162-180 BP Expression inhibition ratio | Growth inhibition ratio |
|---|---|---|---|---|
| 157-2 | Random modification (2'-O-methyl) 5-AUACUUGGCGGGCUCUUUCTT (SEQ ID NO: 1154) TTUAUGAACCGCCCGAGAAAG-5 (SEQ ID NO: 1155) | ++ | 25% | 31% |
| 157-3A | Specific modification (2'-O-methyl) 5-AUACUUGGCGGGCUCUUUCTT (SEQ ID NO: 1156) TTUAUGAACCGCCCGAGAAAG-5 (SEQ ID NO: 1157) | ++ | 70% | 4% |
| 157-3B | Specific modification (2'-O-methyl) 5-AUACUUGGCGGGCUCUUUCTT (SEQ ID NO: 1158) TTUAUGAACCGCCCGAGAAAG-5 (SEQ ID NO: 1159) | ++ | 72% | 1% |

TABLE 158

| gene | Dog B cell lymphoma(NM_001003016) (SEQ ID NO: 498) SIRNA | Locus Stability | 508-526 BP Expression inhibition ratio | Growth inhibition ratio |
|---|---|---|---|---|
| 158-1 | Unmodified siRNA 5-UUGGGGAAGCGGCCGGCGGTT (SEQ ID NO: 1160) TTAACCCCUUCGCCGGCCGCC-5 (SEQ ID NO: 1161) | + | 84% | 0% |
| 158-2 | Random modification (2'-O-methyl) 5-UUGGGGAAGCGGCCGGCGGTT (SEQ ID NO: 1162) TTAACCCCUUCGCCGGCCGCC-5 (SEQ ID NO: 1163) | ++ | 36% | 27% |
| 158-3A | Specific modification (2'-O-methyl) 5-UUGGGGAAGCGGCCGGCGGTT (SEQ ID NO: 1164) TTAACCCCUUCGCCGGCCGCC-5 (SEQ ID NO: 1165) | ++ | 78% | 5% |
| 158-3B | Specific modification (2'-O-methyl) 5-UUGGGGAAGCGGCCGGCGGTT (SEQ ID NO: 1166) TTAACCCCUUCGCCGGCCGCC-5 (SEQ ID NO: 1167) | ++ | 82% | 1% |

TABLE 159

| gene | Dog B cell lymphoma(NM_001003016) (SEQ ID NO: 498) SIRNA | Locus Stability | 794-812 BP Expression inhibition ratio | Growth inhibition ratio |
|---|---|---|---|---|
| 159-1 | Unmodified siRNA 5-AAGGCAUGCUUCGGAAACUTT (SEQ ID NO: 1168) TTUUCCGUACGAAGCCUUUGA-5 (SEQ ID NO: 1169) | + | 96% | 0% |
| 159-2 | Random modification (2'-O-methyl) 5-AAGGCAUGCUUCGGAAACUTT (SEQ ID NO: 1170) TTUUCCGUACGAAGCCUUUGA-5 (SEQ ID NO: 1171) | ++ | 60% | 35% |

TABLE 159-continued

Dog B cell lymphoma (NM_001003016)     794-812 BP

| gene | (SEQ ID NO: 498) SIRNA | Locus Stability | Expression inhibition ratio | Growth inhibition ratio |
|---|---|---|---|---|
| 159-3A | Specific modification (2'-O-methyl)<br>5-AAGGCAUGCUUCGGAAACUTT<br>(SEQ ID NO: 1172)<br>TTUUCCGUACGAAGCCUUUGA-5<br>(SEQ ID NO: 1173) | ++ | 87% | 6% |
| 159-3B | Specific modification (2'-O-methyl)<br>5-AAGGCAUGCUUCGGAAACUTT<br>(SEQ ID NO: 1174)<br>TTUUCCGUACGAAGCCUUUGA-5<br>(SEQ ID NO: 1175) | ++ | 95% | 1% |

TABLE 160

Dog B cell lymphoma (NM_001003016)     801-819 BP

| gene | (SEQ ID NO: 498) SIRNA | Locus Stability | Expression inhibition ratio | Growth inhibition ratio |
|---|---|---|---|---|
| 160-1 | Unmodified siRNA<br>5-GCUUCGGAAACUGGACAUCTT<br>(SEQ ID NO: 1176)<br>TTCGAAGCCUUUGACCUGUAG-5<br>(SEQ ID NO: 1177) | + | 91% | 0% |
| 160-2 | Random modification (2'-deoxy-2'-fluoro)<br>5-GCUUCGGAAACUGGACAUCTT<br>(SEQ ID NO: 1178)<br>TTCGAAGCCUUUGACCUGUAG-5<br>(SEQ ID NO: 1179) | ++ | 29% | 37% |
| 160-3A | Specific modification (2'-deoxy-2'-fluoro)<br>5-GCUUCGGAAACUGGACAUCTT<br>(SEQ ID NO: 1180)<br>TTCGAAGCCUUUGACCUGUAG-5<br>(SEQ ID NO: 1181) | ++ | 87% | 5% |
| 160-3B | Specific modification (2'-deoxy-2'-fluoro)<br>5-GCUUCGGAAACUGGACAUCTT<br>(SEQ ID NO: 1182)<br>TTCGAAGCCUUUGACCUGUAG-5<br>(SEQ ID NO: 1183) | ++ | 90% | 1% |

TABLE 161

Dog B cell lymphoma (NM_001003016)     21-39 BP

| gene | (SEQ ID NO: 498) SIRNA | Locus Stability | Expression inhibition ratio | Growth inhibition ratio |
|---|---|---|---|---|
| 161-1 | Unmodified siRNA<br>5-AACUCUACUGUGGAGUCGGTT<br>(SEQ ID NO: 1184)<br>TTUGAGAUGACACCUCAGCC-5<br>(SEQ ID NO: 1185) | + | 73% | 0% |
| 161-2 | Random modification (2'-deoxy-2'-fluoro)<br>5-AACUCUACUGUGGAGUCGGTT<br>(SEQ ID NO: 1186)<br>TTUGAGAUGACACCUCAGCC-5<br>(SEQ ID NO: 1187) | ++ | 25% | 31% |
| 161-3A | Specific modification (2'-deoxy-2'-fluoro)<br>5-AACUCUACUGUGGAGUCGGTT<br>(SEQ ID NO: 1188)<br>TTUGAGAUGACACCUCAGCC-5<br>(SEQ ID NO: 1189) | ++ | 65% | 8% |

TABLE 161-continued

| | Dog B cell lymphoma (NM_001003016) (SEQ ID NO: 498) | | 21-39 BP | |
|---|---|---|---|---|
| gene | SIRNA | Locus Stability | Expression inhibition ratio | Growth inhibition ratio |
| 161-3B | Specific modification (2'-deoxy-2'-fluoro)<br>5-AACUCUACUGUGGAGUCGGTT<br>(SEQ ID NO: 1190)<br>TTUUGAGAUGACACCUCAGCC-5<br>(SEQ ID NO: 1191) | ++ | 72% | 2% |

TABLE 162

| | Dog B cell lymphoma (NM_001003016) (SEQ ID NO: 498) | | 124-142 BP | |
|---|---|---|---|---|
| gene | SIRNA | Locus Stability | Expression inhibition ratio | Growth inhibition ratio |
| 162-1 | Unmodified siRNA<br>5-AGAAACGCAGUAAUCCGGATT<br>(SEQ ID NO: 1192)<br>TTUCUUUGCGUCAUUAGGCCU-5<br>(SEQ ID NO: 1193) | + | 87% | 0% |
| 162-2 | Random modification (2'-O-methyl)<br>5-AGAAACGCAGUAAUCCGGATT<br>(SEQ ID NO: 1194)<br>TTUCUUUGCGUCAUUAGGCCU-5<br>(SEQ ID NO: 1195) | ++ | 36% | 27% |
| 162-3A | Specific modification (2'-O-methyl)<br>5-AGAAACGCAGUAAUCCGGATT<br>(SEQ ID NO: 1196)<br>TTUCUUUGCGUCAUUAGGCCU-5<br>(SEQ ID NO: 1197) | ++ | 78% | 5% |
| 162-3B | Specific modification (2'-O-methyl)<br>5-AGAAACGCAGUAAUCCGGATT<br>(SEQ ID NO: 1198)<br>TTUCUUUGCGUCAUUAGGCCU-5<br>(SEQ ID NO: 1199) | ++ | 82% | 1% |

TABLE 163

| | rat (NM_001014070.1) (SEQ ID NO: 608) | | 447-465 BP | |
|---|---|---|---|---|
| gene | SIRNA | Locus Stability | Expression inhibition ratio | Growth inhibition ratio |
| 163-1 | Unmodified siRNA<br>5-GGAAGUCCACCUUCUCCGATT<br>(SEQ ID NO: 1200)<br>TTCCUUCAGGUGGAAGAGGCU-5<br>(SEQ ID NO: 1201) | + | 55% | 0% |
| 163-2 | Random modification (2'-O-methyl)<br>5-GGAAGUCCACCUUCUCCGATT<br>(SEQ ID NO: 1202)<br>TTCCUUCAGGUGGAAGAGGCU-5<br>(SEQ ID NO: 1203) | ++ | 27% | 31% |
| 163-3A | Specific modification (2'-O-methyl)<br>5-GGAAGUCCACCUUCUCCGATT<br>(SEQ ID NO: 1204)<br>TTCCUUCAGGUGGAAGAGGCU-5<br>(SEQ ID NO: 1205) | ++ | 51% | 5% |
| 163-3B | Specific modification (2'-O-methyl)<br>5-GGAAGUCCACCUUCUCCGATT<br>(SEQ ID NO: 1206)<br>TTCCUUCAGGUGGAAGAGGCU-5<br>(SEQ ID NO: 1207) | ++ | 54% | 1% |

TABLE 164

| gene | rat(NM_001014070.1)<br>(SEQ ID NO: 608)<br>SIRNA | Locus<br>Stability | 460-478 BP | |
|---|---|---|---|---|
| | | | Expression<br>inhibition ratio | Growth<br>inhibition ratio |
| 164-1 | Unmodified siRNA<br>5-CUCCGACAGAUGAAGGAAATT<br>(SEQ ID NO: 1208)<br>TTGAGGCUGUCUACUUCCUUU-5<br>(SEQ ID NO: 1209) | + | 73% | 0% |
| 164-2 | Random modification (2'-O-methyl)<br>5-CUCCGACAGAUGAAGGAAATT<br>(SEQ ID NO: 1210)<br>TT**GAGGCUGUCUACUUCCUUU-5<br>(SEQ ID NO: 1211) | ++ | 46% | 21% |
| 164-3A | Specific modification (2'-O-methyl)<br>5-CUCCGACAGAUGAAGGAAATT<br>(SEQ ID NO: 1212)<br>TTGAGGCUGUCUACUUCCUUU-5<br>(SEQ ID NO: 1213) | ++ | 70% | 6% |
| 164-3B | Specific modification (2'-O-methyl)<br>5-CUCCGACAGAUGAAGGAAATT<br>(SEQ ID NO: 1214)<br>TTGAGGCUGUCUACUUCCUUU-5<br>(SEQ ID NO: 1215) | ++ | 72% | 1% |

TABLE 165

| gene | rat(NM_001014070.1)<br>(SEQ ID NO: 608)<br>SIRNA | Locus<br>Stability | 487-505 BP | |
|---|---|---|---|---|
| | | | Expression<br>inhibition ratio | Growth<br>inhibition ratio |
| 165-1 | Unmodified siRNA<br>5-AAGGACCUAGAGGAGUCACTT<br>(SEQ ID NO: 1216)<br>TTUUCCUGGAUCUCCUCAGUG-5<br>(SEQ ID NO: 1217) | + | 83% | 0% |
| 165-2 | Random modification (2'-O-methyl)<br>5-AAGGACCUAGAGGAGUCACTT<br>(SEQ ID NO: 1218)<br>TTUUCCUGGAUCUCCUCAGUG-5<br>(SEQ ID NO: 1219) | ++ | 36% | 27% |
| 165-3A | Specific modification (2'-O-methyl)<br>5-AAGGACCUAGAGGAGUCACTT<br>(SEQ ID NO: 1220)<br>TTUUCCUGGAUCUCCUCAGUG-5<br>(SEQ ID NO: 1221) | ++ | 78% | 5% |
| 165-3B | Specific modification (2'-O-methyl)<br>5-AAGGACCUAGAGGAGUCACTT<br>(SEQ ID NO: 1222)<br>TTUUCCUGGAUCUCCUCAGUG-5<br>(SEQ ID NO: 1223) | ++ | 80% | 1% |

TABLE 166

| gene | rat(NM_001014070.1) (SEQ ID NO: 608)<br>SIRNA | Locus<br>Stability | 614-632 BP | |
|---|---|---|---|---|
| | | | Expression<br>inhibition ratio | Growth<br>inhibition ratio |
| 166-1 | Unmodified siRNA<br>5-CUGACCGGAAGCGCUUAAATT<br>(SEQ ID NO: 1224)<br>TTGACUGGCCUUCGCGAAUUU-5<br>(SEQ ID NO: 1225) | + | 90% | 0% |

TABLE 166-continued

| gene | rat(NM_001014070.1) (SEQ ID NO: 608) SIRNA | Locus Stability | 614-632 BP Expression inhibition ratio | Growth inhibition ratio |
|---|---|---|---|---|
| 166-2 | Random modification (2'-deoxy-2'-fluoro)<br>5-CUGACCGGAAGCGCUUAAATT<br>(SEQ ID NO: 1226)<br>TTGACUGGCCUUCGCGAAUUU-5<br>(SEQ ID NO: 1227) | ++ | 59% | 24% |
| 166-3A | Specific modification (2'-deoxy-2'-fluoro)<br>5-C<u>UG</u>ACCGGAAG<u>CG</u>CU<u>UA</u>AATT<br>(SEQ ID NO: 1228)<br>TTG<u>AC</u>UGGCCUUCGC<u>GA</u><u>AU</u>UU-5<br>(SEQ ID NO: 1229) | ++ | 85% | 4% |
| 166-3B | Specific modification (2'-deoxy-2'-fluoro)<br>5-C<u>UG</u>ACCGGAAGCGCU<u>UA</u>AATT<br>(SEQ ID NO: 1230)<br>TTG<u>AC</u>UGGCCUUCGCGA<u>AU</u>UU-5<br>(SEQ ID NO: 1231) | ++ | 87% | 1% |

TABLE 167

| gene | rat(NM_001014070.1)<br>(SEQ ID NO: 608) SIRNA | Locus Stability | 1257-1275 BP Expression inhibition ratio | Growth inhibition ratio |
|---|---|---|---|---|
| 167-1 | Unmodified siRNA<br>5-GAAGAGCCUACACAACCCUTT<br>(SEQ ID NO: 1232)<br>TTCUUCUCGGAUGUGUUGGGA-5<br>(SEQ ID NO: 1233) | + | 76% | 0% |
| 167-2 | Random modification (2'-O-methyl)<br>5-GAAGAGCCUACACAACCCUTT<br>(SEQ ID NO: 1234)<br>TTCUUCUCGGAUGUGUUGGGA-5<br>(SEQ ID NO: 1235) | ++ | 43% | 31% |
| 167-3A | Specific modification (2'-O-methyl)<br>5-GAAGAGCC<u>UACACA</u>ACCCUTT<br>(SEQ ID NO: 1236)<br>TTCUUCUCGG<u>AUGUGU</u>UGGGA-5<br>(SEQ ID NO: 1237) | ++ | 74% | 10% |
| 167-3B | Specific modification (2'-O-methyl)<br>5-GAAGAGCC<u>UACACA</u>ACCCUTT<br>(SEQ ID NO: 1238)<br>TTCUUCUCGG<u>AUGUGU</u>UGGGA-5<br>(SEQ ID NO: 1239) | ++ | 74% | 3% |

TABLE 168

| gene | Rat BIRC5(NM_022274)<br>(SEQ ID NO: 728) SIRNA | Locus Stability | 364-382 BP Expression inhibition ratio | Growth inhibition ratio |
|---|---|---|---|---|
| 168-1 | Unmodified siRNA<br>5-ACAGAAAGAGUUCGAGGAGTT<br>(SEQ ID NO: 1240)<br>TTUGUCUUUCUCAAGCUCCUC-5<br>(SEQ ID NO: 1241) | + | 65% | 0% |
| 168-2 | Random modification (2'-O-methyl)<br>5-ACAGAAAGAGUUCGAGGAGTT<br>(SEQ ID NO: 1242)<br>TTUGUCUUUCUCAAGCUCCUC-5<br>(SEQ ID NO: 1243) | ++ | 37% | 28% |

TABLE 168-continued

| gene | Rat BIRC5(NM_022274)<br>(SEQ ID NO: 728)<br>SIRNA | Locus<br>Stability | 364-382 BP | |
|---|---|---|---|---|
| | | | Expression<br>inhibition ratio | Growth<br>inhibition ratio |
| 168-3A | Specific modification (2'-O-methyl)<br>5-ACAGAAAGAGUUCGAGGAGTT<br>(SEQ ID NO: 1244)<br>TTUGUCUUUCUCAAGCUCCUC-5<br>(SEQ ID NO: 1245) | ++ | 61% | 6% |
| 168-3B | Specific modification (2'-O-methyl)<br>5-ACAGAAAGAGUUCGAGGAGTT<br>(SEQ ID NO: 1246)<br>TTUGUCUUUCUCAAGCUCCUC-5<br>(SEQ ID NO: 1247) | ++ | 64% | 1% |

TABLE 169

| gene | Rat BIRC5(NM_022274) (SEQ ID NO: 728)<br>SIRNA | Locus<br>Stability | 527-545 BP | |
|---|---|---|---|---|
| | | | Expression<br>inhibition ratio | Growth<br>inhibition ratio |
| 169-1 | Unmodified siRNA<br>5-AGGAGACCGUGACAUUUCGTT<br>(SEQ ID NO: 1248)<br>TTCCUCUGGCACUGUAAAGC-5<br>(SEQ ID NO: 1249) | + | 75% | 0% |
| 169-2 | Random modification (2'-deoxy-2'-fluoro)<br>5-AGGAGACCGUGACAUUUCGTT<br>(SEQ ID NO: 1250)<br>TTCCUCUGGCACUGUAAAGC-5<br>(SEQ ID NO: 1251) | +++ | 33% | 24% |
| 169-3A | Specific modification (2'-deoxy-2'-fluoro)<br>5-AGGAGACCGUGACAUUUCGTT<br>(SEQ ID NO: 1252)<br>TTCCUCUGGCACUGUAAAGC-5<br>(SEQ ID NO: 1253) | +++ | 69% | 6% |
| 169-3B | Specific modification (2'-deoxy-2'-fluoro)<br>5-AGGAGACCGUGACAUUUCGTT<br>(SEQ ID NO: 1254)<br>TTCCUCUGGCACUGUAAAGC-5<br>(SEQ ID NO: 1255) | +++ | 72% | 3% |

TABLE 170

| gene | Rat BIRC5(NM_022274) (SEQ ID NO: 728)<br>SIRNA | Locus<br>Stability | 42-60 BP | |
|---|---|---|---|---|
| | | | Expression<br>inhibition ratio | Growth<br>inhibition ratio |
| 170-1 | Unmodified siRNA<br>5-ACCUUAAGGACCACCGGAUTT<br>(SEQ ID NO: 1256)<br>TTGGAAUUCCUGGUGGCCUA-5<br>(SEQ ID NO: 1257) | + | 73% | 0% |
| 170-2 | Random modification (2'-deoxy-2'-fluoro)<br>5-ACCUUAAGGACCACCGGAUTT<br>(SEQ ID NO: 1258)<br>TTGGAAUUCCUGGUGGCCUA-5<br>(SEQ ID NO: 1259) | ++ | 41% | 25% |
| 170-3A | Specific modification (2'-deoxy-2'-fluoro)<br>5-ACCUUAAGGACCACCGGAUTT<br>(SEQ ID NO: 1260)<br>TTGGAAUUCCUGGUGGCCUA-5<br>(SEQ ID NO: 1261) | ++ | 70% | 8% |

TABLE 170-continued

| gene | Rat BIRC5(NM_022274) (SEQ ID NO: 728) SIRNA | Locus Stability | 42-60 BP Expression inhibition ratio | Growth inhibition ratio |
|---|---|---|---|---|
| 170-3B | Specific modification (2'-deoxy-2'-fluoro)<br>5-ACCUUAAGGACCACCGGAUTT<br>(SEQ ID NO: 1262)<br>TTUGGAAUUCCUGGUGGCCUA-5<br>(SEQ ID NO: 1263) | ++ | 71% | 1% |

TABLE 171

| gene | Rat BIRC5(NM_022274) (SEQ ID NO: 728) SIRNA | Locus Stability | 56-74 BP Expression inhibition ratio | Growth inhibition ratio |
|---|---|---|---|---|
| 171-1 | Unmodified siRNA<br>5-CGGAUCUACACCUUCAAGATT<br>(SEQ ID NO: 1264)<br>TTGCCUAGAUGUGGAAGUUCU-5<br>(SEQ ID NO: 1265) | + | 44% | 0% |
| 171-2 | Random modification (2'-O-methyl)<br>5-CGGAUCUACACCUUCAAGATT<br>(SEQ ID NO: 1266)<br>TTGCCUAGAUGUGGAAGUUCU-5<br>(SEQ ID NO: 1267) | ++ | 29% | 27% |
| 171-3A | Specific modification (2'-O-methyl)<br>5-CGGAUCUACACCUUCAAGATT<br>(SEQ ID NO: 1268)<br>TTGCCUAGAUGUGGAAGUUCU-5<br>(SEQ ID NO: 1269) | ++ | 40% | 9% |
| 171-3B | Specific modification (2'-O-methyl)<br>5-CGGAUCUACACCUUCAAGATT<br>(SEQ ID NO: 1270)<br>TTGCCUAGAUGUGGAAGUUCU-5<br>(SEQ ID NO: 1271) | ++ | 42% | 2% |

TABLE 172

| gene | Rat BIRC5(NM_022274) (SEQ ID NO: 728) SIRNA | Locus Stability | 183-201 BP Expression inhibition ratio | Growth inhibition ratio |
|---|---|---|---|---|
| 172-1 | Unmodified siRNA<br>5-GCUUUAAGGAACUGGAAGGTT<br>(SEQ ID NO: 1272)<br>TTCGAAAUUCCUUGACCUUCC-5<br>(SEQ ID NO: 1273) | + | 77% | 0% |
| 172-2 | Random modification (2'-O-methyl)<br>5-GCUUUAAGGAACUGGAAGGTT<br>(SEQ ID NO: 1274)<br>TTCGAAAUUCCUUGACCUUCC-5<br>(SEQ ID NO: 1275) | ++ | 51% | 29% |
| 172-3A | Specific modification (2'-O-methyl)<br>5-GCUUUAAGGAACUGGAAGGTT<br>(SEQ ID NO: 1276)<br>TTCGAAAUUCCUUGACCUUCC-5<br>(SEQ ID NO: 1277) | ++ | 72% | 8% |
| 172-3B | Specific modification (2'-O-methyl)<br>5-GCUUUAAGGAACUGGAAGGTT<br>(SEQ ID NO: 1278)<br>TTCGAAAUUCCUUGACCUUCC-5<br>(SEQ ID NO: 1279) | ++ | 74% | 1% |

TABLE 173

| gene | Mice (NM_008960.2) (SEQ ID NO: 19) SIRNA | Locus Stability | 290-308 BP Expression inhibition ratio | Growth inhibition ratio |
|---|---|---|---|---|
| 173-1 | Unmodified siRNA<br>5-GAGAGAGACGGUGGAAGAATT<br>(SEQ ID NO: 1280)<br>TTCUCUCUCUGCCACCUUCUU-5<br>(SEQ ID NO: 1281) | + | 75% | 0% |
| 173-2 | Random modification (2'-O-methyl)<br>5-GAGAGAGACGGUGGAAGAATT<br>(SEQ ID NO: 1282)<br>TTCUCUCUCUGCCACCUUCUU-5<br>(SEQ ID NO: 1283) | +++ | 56% | 22% |
| 173-3A | Specific modification (2'-O-methyl)<br>5-GAGAGAGACGGUGGAAGAATT<br>(SEQ ID NO: 1284)<br>TTCUCUCUCUGCCACCUUCUU-5<br>(SEQ ID NO: 1285) | +++ | 72% | 4% |
| 173-3B | Specific modification (2'-O-methyl)<br>5-GAGAGAGACGGUGGAAGAATT<br>(SEQ ID NO: 1280)<br>TTCUCUCUCUGCCACCUUCUU-5<br>(SEQ ID NO: 1286) | +++ | 74% | 1% |

TABLE 174

| gene | Mice (NM_008960.2) (SEQ ID NO: 19) SIRNA | Locus Stability | 791-809 BP Expression inhibition ratio | Growth inhibition ratio |
|---|---|---|---|---|
| 174-1 | Unmodified siRNA<br>5-AUCCUGCAGAAGAAGCCUCTT<br>(SEQ ID NO: 1287)<br>TTUAGGACGUCUUCUUCGGAG-5<br>(SEQ ID NO: 1288) | + | 53% | 0% |
| 174-2 | Random modification (2'-O-methyl)<br>5-AUCCUGCAGAAGAAGCCUCTT<br>(SEQ ID NO: 1289)<br>TTUAGGACGUCUUCUUCGGAG-5<br>(SEQ ID NO: 1290) | ++ | 37% | 24% |
| 174-3A | Specific modification (2'-O-methyl)<br>5-AUCCUGCAGAAGAAGCCUCTT<br>(SEQ ID NO: 1291)<br>TTUAGGACGUCUUCUUCGGAG-5<br>(SEQ ID NO: 1292) | ++ | 50% | 6% |
| 174-3B | Specific modification (2'-O-methyl)<br>5-AUCCUGCAGAAGAAGCCUCTT<br>(SEQ ID NO: 1293)<br>TTUAGGACGUCUUCUUCGGAG-5<br>(SEQ ID NO: 1288) | ++ | 74% | 1% |

TABLE 175

| gene | Mice (NM_008960.2) (SEQ ID NO: 19) SIRNA | Locus Stability | 247-265 BP Expression inhibition ratio | Growth inhibition ratio |
|---|---|---|---|---|
| 175-1 | Unmodified siRNA<br>5-UCCUCGUCGUCUGUUCUAATT<br>(SEQ ID NO: 1294)<br>TTAGGAGCAGCAGACAAGAUU-5<br>(SEQ ID NO: 1295) | + | 84% | 0% |

TABLE 175-continued

|  |  |  | 247-265 BP | |
| --- | --- | --- | --- | --- |
| gene | Mice (NM_008960.2) (SEQ ID NO: 19) SIRNA | Locus Stability | Expression inhibition ratio | Growth inhibition ratio |
| 175-2 | Random modification (2'-deoxy-2'-fluoro)<br>5-UCCUCGUCGUCUGUUCUAATT<br>(SEQ ID NO: 1296)<br>TTAGGAGCAGCAGACAAGAUU-5<br>(SEQ ID NO: 1297) | ++ | 49% | 23% |
| 175-3A | Specific modification (2'-deoxy-2'-fluoro)<br>5-UCCUCGUCG<u>UC</u>UG<u>UU</u>C<u>UA</u>ATT<br>(SEQ ID NO: 1298)<br>TTAGGAGCAGCAG<u>AC</u>AAG<u>AU</u>U-5<br>(SEQ ID NO: 1299) | ++ | 77% | 6% |
| 175-3B | Specific modification (2'-deoxy-2'-fluoro)<br>5-UCCUCGUCGUC<u>UG</u>UUC<u>UA</u>ATT<br>(SEQ ID NO: 1300)<br>TTAGGAGCAGCAG<u>AC</u>AAG<u>AU</u>U-5<br>(SEQ ID NO: 1301) | ++ | 74% | 1% |

TABLE 176

|  |  |  | 1148-1166 BP | |
| --- | --- | --- | --- | --- |
| gene | Mice (NM_008960.2) (SEQ ID NO: 19) SIRNA | Locus Stability | Expression inhibition ratio | Growth inhibition ratio |
| 176-1 | Unmodified siRNA<br>5-AACCCACCACAGCUAGAACUU<br>(SEQ ID NO: 1302)<br>UUUUGGGUGGUGUCGAUCUUG-5<br>(SEQ ID NO: 1303) | + | 89% | 0% |
| 176-2 | Random modification (2'-deoxy-2'-fluoro)<br>5-AACCCACCACAGCUAGAACUU<br>(SEQ ID NO: 1304)<br>UUUUGGGUGGUGUCGAUCUUG-5<br>(SEQ ID NO: 1305) | +++ | 57% | 21% |
| 176-3A | Specific modification (2'-deoxy-2'-fluoro)<br>5-AACC<u>CA</u>C<u>CA</u>CAGC<u>UA</u>GAACUU<br>(SEQ ID NO: 1306)<br>UUUUGGG<u>UG</u>G<u>UG</u>U<u>CGAU</u>CUUG-5<br>(SEQ ID NO: 1307) | +++ | 79% | 9% |
| 176-3B | Specific modification (2'-deoxy-2'-fluoro)<br>5-AACC<u>CA</u>C<u>CA</u>CAGC<u>UA</u>GAACUU<br>(SEQ ID NO: 1308)<br>UUUUGGG<u>UG</u>G<u>UG</u>U<u>CGAU</u>CUUG-5<br>(SEQ ID NO: 1309) | +++ | 86% | 1% |

TABLE 177

|  |  |  | 3694-3712 BP | |
| --- | --- | --- | --- | --- |
| gene | Mice (NM_008960.2) (SEQ ID NO: 19) SIRNA | Locus Stability | Expression inhibition ratio | Growth inhibition ratio |
| 177-1 | Unmodified siRNA<br>5-UUACAAAGGAUCUCCUCCCTT<br>(SEQ ID NO: 1310)<br>TTAAUGUUUCCUAGAGGAGGG-5<br>(SEQ ID NO: 1311) | + | 77% | 0% |
| 177-2 | Random modification (2'-O-methyl)<br>5-UUACAAAGGAUCUCCUCCCTT<br>(SEQ ID NO: 1312)<br>TTAAUGUUUCCUAGAGGAGGG-5<br>(SEQ ID NO: 1313) | ++ | 51% | 29% |

TABLE 177-continued

| gene | Mice (NM_008960.2) (SEQ ID NO: 19) SIRNA | Locus Stability | 3694-3712 BP Expression inhibition ratio | Growth inhibition ratio |
|---|---|---|---|---|
| 177-3A | Specific modification (2'-O-methyl)<br>5-UUACAAAGGAUCUCCUCCCTT<br>(SEQ ID NO: 1314)<br>TTAAUGUUUCCUAGAGGAGGG-5<br>(SEQ ID NO: 1315) | ++ | 72% | 6% |
| 177-3B | Specific modification (2'-O-methyl)<br>5-UUACAAAGGAUCUCCUCCCTT<br>(SEQ ID NO: 1316)<br>TTAAUGUUUCCUAGAGGAGGG-5<br>(SEQ ID NO: 1317) | ++ | 74% | 1% |

TABLE 178

| gene | *Aspergillus* AF293 protein(XM_748400) (SEQ ID NO: 851) SIRNA | Locus Stability | 75-93 BP Expression inhibition ratio | Growth inhibition ratio |
|---|---|---|---|---|
| 178-1 | Unmodified siRNA<br>5-AAACGAGAGAGCCCACCUUTT<br>(SEQ ID NO: 1318)<br>TTUUUGCUCUCUCGGGUGGAA-5<br>(SEQ ID NO: 1319) | + | 58% | 0% |
| 178-2 | Random modification (2'-O-methyl)<br>5-AAACGAGAGAGCCCACCUUTT<br>(SEQ ID NO: 1320)<br>TTUUUGCUCUCUCGGGUGGAA-5<br>(SEQ ID NO: 1321) | +++ | 37% | 27% |
| 178-3A | Specific modification (2'-O-methyl)<br>5-AAACGAGAGAGCCCCACCUUTT<br>(SEQ ID NO: 1322)<br>TTUUUGCUCUCUCGGGUGGAA-5<br>(SEQ ID NO: 1323) | +++ | 56% | 4% |
| 178-3B | Specific modification (2'-O-methyl)<br>5-AAACGAGAGAGCCCCACCUUTT<br>(SEQ ID NO: 1318)<br>TTUUUGCUCUCUCGGGUGGAA-5<br>(SEQ ID NO: 1324) | +++ | 57% | 1% |

TABLE 179

| gene | *Aspergillus* AF293 protein(XM_748400) (SEQ ID NO: 851) SIRNA | Locus Stability | 137-155 BP Expression inhibition ratio | Growth inhibition ratio |
|---|---|---|---|---|
| 179-1 | Unmodified siRNA<br>5-AAAGCGGUGGAUCAGCUCUTT<br>(SEQ ID NO: 1325)<br>TTUUUCGCCACCUAGUCGAGA-5<br>(SEQ ID NO: 1326) | + | 69% | 0% |
| 179-2 | Random modification (2'-O-methyl)<br>5-AAAGCGGUGGAUCAGCUCUTT<br>(SEQ ID NO: 1327)<br>TTUUUCGCCACCUAGUCGAGA-5<br>(SEQ ID NO: 1328) | ++ | 43% | 24% |
| 179-3A | Specific modification (2'-O-methyl)<br>5-AAAGCGGUGGAUCAGCUCUTT<br>(SEQ ID NO: 1329)<br>TTUUUCGCCACCUAGUCGAGA-5<br>(SEQ ID NO: 1330) | ++ | 63% | 10% |

TABLE 179-continued

| gene | Aspergillus AF293 protein(XM_748400) (SEQ ID NO: 851) SIRNA | Locus Stability | 137-155 BP Expression inhibition ratio | Growth inhibition ratio |
|---|---|---|---|---|
| 179-3B | Specific modification (2'-O-methyl)<br>5-AAAGCGG<u>UG</u>GAU<u>CA</u>GCUCUTT<br>(SEQ ID NO: 1325)<br>TTUUUCGCC<u>AC</u>CUA<u>GU</u>CGAGA-5<br>(SEQ ID NO: 1331) | ++ | 67% | 1% |

TABLE 180

| gene | Aspergillus AF293 protein(XM_748400) (SEQ ID NO: 851) SIRNA | Locus Stability | 360-378 BP Expression inhibition ratio | Growth inhibition ratio |
|---|---|---|---|---|
| 180-1 | Unmodified siRNA<br>5-UCCAAGCUUCCUCGUUGGUTT<br>(SEQ ID NO: 1332)<br>TTAGGUUCGAAGGAGCAACCA-5<br>(SEQ ID NO: 1333) | + | 71% | 0% |
| 180-2 | Random modification (2'-deoxy-2'-fluoro)<br>5-UCCAAGCUUCCUCGUUGGUTT<br>(SEQ ID NO: 1334)<br>TTAGGUUCGAAGGAGCAACCA-5<br>(SEQ ID NO: 1335) | ++ | 51% | 28% |
| 180-3A | Specific modification (2'-deoxy-2'-fluoro)<br>5-UC<u>CA</u>AGCUUCCUCGU<u>UG</u>GUTT<br>(SEQ ID NO: 1336)<br>TTAGG<u>UU</u>CGAAGGAGCA<u>AC</u>CA-5<br>(SEQ ID NO: 1337) | ++ | 65% | 7% |
| 180-3B | Specific modification (2'-deoxy-2'-fluoro)<br>5-UC<u>CA</u>AGCUUCCUCGU<u>UG</u>GUTT<br>(SEQ ID NO: 1332)<br>TTAGG<u>UU</u>CGAAGGAGCA<u>AC</u>CA-5<br>(SEQ ID NO: 1338) | ++ | 71% | 0% |

TABLE 181

| gene | Aspergillus AF293 protein (XM_748400) (SEQ ID NO: 851) SIRNA | Locus Stability | 14-32 BP Expression inhibition ratio | Growth inhibition ratio |
|---|---|---|---|---|
| 181-1 | Unmodified siRNA<br>5-AGAGAGGUGGAGGUAUCUCTT<br>(SEQ ID NO: 1339)<br>TTUCUCUCCACCUCCAUAGAG-5<br>(SEQ ID NO: 1340) | + | 90% | 0% |
| 181-2 | Random modification (2'-deoxy-2'-fluoro)<br>5-AGAGAGGUGGAGGUAUCUCTT<br>(SEQ ID NO: 1341)<br>TTUCUCUCCACCUCCAUAGAG-5<br>(SEQ ID NO: 1342) | +++ | 68% | 26% |
| 181-3A | Specific modification (2'-deoxy-2'-fluoro)<br>5-AGAGAGG<u>UG</u>GAGG<u>UA</u>UC<u>UC</u>TT<br>(SEQ ID NO: 1353)<br>TTUCUCUCC<u>AC</u>CUCC<u>AU</u>AGAG-5<br>(SEQ ID NO: 1354) | +++ | 85% | 7% |
| 181-3B | Specific modification (2'-deoxy-2'-fluoro)<br>5-AGAGAGG<u>UG</u>GAGG<u>UA</u>UCUCTT<br>(SEQ ID NO: 1343)<br>TTUCUCUCC<u>AC</u>CUCC<u>AU</u>AGAG-5<br>(SEQ ID NO: 1344) | +++ | 88% | 1% |

TABLE 182

| gene | *Aspergillus* AF293 protein(XM_748400) (SEQ ID NO: 851) SIRNA | Locus Stability | 1238-1256 BP Expression inhibition ratio | Growth inhibition ratio |
|---|---|---|---|---|
| 182-1 | Unmodified siRNA<br>5-CCGAAGACGAAGCUAUGAATT<br>(SEQ ID NO: 1345)<br>TTGGCUUCUGCUUCGAUACUU-5<br>(SEQ ID NO: 1346) | + | 73% | 0% |
| 182-2 | Random modification (2'-O-methyl)<br>5-CCGAAGACGAAGCUAUGAATT<br>(SEQ ID NO: 929)<br>TTGGCUUCUGCUUCGAUACUU-5<br>(SEQ ID NO: 930) | +++ | 51% | 29% |
| 182-3A | Specific modification (2'-O-methyl)<br>5-CCGAAGACGAAGCUAUGAATT<br>(SEQ ID NO: 1355)<br>TTGGCUUCUGCUUCGAUACUU-5<br>(SEQ ID NO: 932) | +++ | 69% | 6% |
| 182-3B | Specific modification (2'-O-methyl)<br>5-CCGAAGACGAAGCUAUGAATT<br>(SEQ ID NO: 1347)<br>TTGGCUUCUGCUUCGAUACUU-5<br>(SEQ ID NO: 1348) | +++ | 71% | 1% |

In tables 1-182:
Chemically modified nucleotides were indicated by bold letters of "A", "U", "G" or "C";
"+" indicates the situation that after serum treatment, the main siRNA band disappeared completely, while evident siRNA degradation bands were observed;
"++" indicates the situation that after serum treatment, the main siRNA band remains visible although degradation occurs, at the same time, siRNA degradation bands are easily observed;
"+++" indicates the situation that after serum treatment, no obvious degradation occurs with the main siRNA band, no siRNA degradation band is observed.

In addition, as shown in table 1-182, the specific siRNA modification strategy provided by the present invention greatly improves serum stability of the siRNAs; while at the same time, reduces their cytotoxicity and does not compromise their gene silencing activity. Thus, the present invention can achieve siRNA stabilization with minimal chemical modifications, decreases their potential cytotoxicity and influence on gene silencing activity.

SEQUENCE LISTING (1355 sequences)

SEQ ID NO: 1 - DNA, 6047 bp, Homo sapiens
ggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaagtgctcctgcgggaagaagtgtcgcggctccaggaggaagttcaccttctccggcagatgaaggagatgttggcgaaggacctggaggagtcgcagggcggcaagtcctctgaggtcctctcggccaccgagctcagggtccagctggcccagaaggagcaggagctagccagagccaaagaagccttgcaggccatgaaagctgatcggaagcgcttaaagggcgagaagacagacctggtgagccagatgcagcagctgtatgccacactggagagccgcgaggagcagctccgagacttcatccgcaactatgagcagcaccgcaaggagagcgaggatgcggtcaaagcgctggccaaggagaaggacctgctggagcgtgagaagtgggagctgcggcgccaagccaaggaggccacagaccacgccacggcactgcgctcccagctggacctcaaggacaaccggatgaaggagctggaggccgagctggccatggccaaacagtccttagctacgctgaccaaggacgtccccaagcggcattccctcgccatgccgggcgagacggtgctcaatggcaaccaggagtgggtggtgcaggcggacctcccgctgaccgcagccatccggcagagtcaacagactctctaccactcacacccccctcaccctgcggaccggcaagcggtcagggtgagcccctgccactcccggcagccctctgtcatctccgacgcatctgccgccgaaggcgaccggtcgtccacaccgagcgacatcaactcccctcgacaccggacacactccctctgcaacggcgacagtcccggcccagttcagaagaacctgcacaaccctattgtacagtcactagaggatcttgaagaccaaaaacggaaaaagaagaaagagaagatgggattcggctccatctcccgcgtcttcgccagagggaagcagcggaagtccctcgaccccggcctctttgatgactcggacagccagtgcagccccacgcggcagagcctcagcctgtcggaaggcgaggagcagatggaccggctgcagcaggtggagctggtgaggaccacccctatgtcccactggaaggcgggcaccgtccaggcctggctggaggtggtgatggccatgcctatgtacgtcaaggcctgcacggagaacgtgaagagcgggaaggtgctgctgagcctgagtgacgaggacctgcagctgggccttggggtgtgcagctccctgcaccggcgcaagctgcgcctggccatcgaggactaccgtgatgccgaggcaggccgcagcctgtccaaagctgccgagctggaccatcactgggtggccaaggcctggctgaatgacattggcctgtcccagtactcccaggcctttcagaaccacctggttgatgggcggatgctgaattccctgatgaagcgagacctggagaagcacctgaacgtgtccaagaagttccaccaggtcagcatcctgctggggatcgagctgctgtaccaagtgaacttcagcagggaggccctccaggagcgccgggcccgctgcgagacgcagaacattgaccccgtggtgtggaccaaccagcgggtgctcaagtgggttcgagacatcgacctgaaggagtacgcagacaacctgaccaacagcggcgtccatggtgctgtgctggtgctggagcccacattcaatgccgaggccatggccactgccctgggcatccccagtgggaagcacatcctccggagacacctggcagaggagatgagcgccgtcttccacccagccaactccacaggcatccgggaggctgagcgttttggaacgccccctggcagggcctccagcgtcacgcgggcaggaaaggaggagaacagcagcggtctcaagtacaaggctggccggctgcccctggggaagataggaaggggcttcagcagcaaagatcccgatttccatgatgactatggctctcttcaaaacgaagattgcggagacgatgacccccagagcaggctggaacagtgccgtctggaaggctacaacagcctggaggtcaccaacgtgtaaggaactggtggctccaccagacccaacgtgagagacccaggaaggaagagaagccagatggccccaggtgtcgttctcactgtacatagcggccgcaggctgaggatgtcccttgctcctgggcaaaatcccgatggactctgcggtttcagctccacagcgcccaggagagagaagacaccagcccacctgtcttgggtgggccatggactttcctgttcagctggagatgggcccagaggacctgtcacagtgtccggccctgcctccatccaggatacacaggctccacctcagagtgaccgtcactgtggagcagccaagcagtccctggagccttaaacggagctgccaaggtgggaggaggcccacagttccctaaaacacccttccggcgggagcaggggggaccccaaccccacaccccagcgcccagtgcattggcagagccgggtgcaggaagtgctgcctcttgccgagacgtcggacagggcgggggttggggaactctcggctacagcatcttacccttgactgagaacttgggtcctgacttggctcactgaatctctcttgggagaatgcaaaatccttccacctgaaaagctctgtgacacatgggggtggacgtattgaagagctgtttgccgatccacccaggagtggctacgctgagtggggagccggtgaatgatccgtgcaggagtggggcttagcagccacatttctaggagatgcagatatcctatcaccagaatgaaagctattgggacaacaggatcggggatgaccgacggccccatatggtgaatctctggcctgtggtttggctttactgagattccaaaccccactatctgcactccgtgacagtggtatggagtgtggcaatgagtttggggtctggggcagggaaatgcttgacattgttaacccaacaaacctttgttgtgatgtccctgtcacctgaaacataggtgacatagctcaccaatgtcctaaccgagacacaaactccacagagcaaaatcatttggtattggtggggagaaccccagcccttttcttgacctgccactgttatgctgtgtggcttcttcccagtggcctcacctctctgtgcctcgatgtcttcatctacgatacttctggttccctcccagggacatcgtgaggattaacacttgctaatatctgtaacacaatttgtaacctctcaggagacaatgggaagttatggggtagctaatttcccatttacaacacagaaatgatatagagctagttcgctccaactctttaggttgaagcagtgtgcaaaaggaagaaaagaaatgtttaatgttcagacctgccaagagcctccaacagggctcaagaaacatataaatcccatgagcacagccttgaaaaccagtttgactcaagccttcgggcctcagttcattgaccagatgacagccacgtgatgattagggaaggacggatgcattgcgattctgcttacacatcgggttatcaaagcgagtcacttgttggaaccatgatgctcgacctccttcaaggccgtttgcactggggcttgagtttccaagattcacaacaggtgtcagcctctgagaaccctcaaagcgtgtgttcttcaacctggcaaattgtttcctctcatgggggaagccgagctctgatgaacttgagaattacacctctctcatgccgaagaccgtggtgttccccctaatgacataaacgcagcctttcttgctgtctgagaccaaatgtctagttggtagacaggtggatgtttggcctcctaagggcacacttctgatcctgggccccaggtggtgaatctctggcatgtggcttggctttgttgagactccaaattccattatcttcatgacattcggcctcatccatagggtcctgaagctgcagtccacagctcagaaaggagaggtgagacctccctccaacctggtgccacaggtctctcccaagccacatccagcctggatgacctgggaccccagaaactgccgtttgggaggcagcaacagcaacgtgcccaggcaggcagttattcccacagagtgagccagaattgtagcagggcacttgaatgcagagctgatgatttgaaaccaacgttcacccaacttgtcagaaatggcacttacatggttcgatcttgctggagacaagtggacaattgggggtcactggcagagacagtattgcccaaaatgttcacagcaggaggccagcaggcctgaggcaacacgggcaaccgcgaatgcctcttttggtttaaattatgccatcacaaccctctttcacccatgaggctccccatccctgacagccaggtgagcatttggagctggtttctcaacatgaggatgggttggttgttaaattaacaacctccacagtatcagattgagtgagctttgtctgctggaaaaacctgaaacgtcaactctgcttcaaggtcggcaagaagaacagaaggcggagacttggcagagagactcaagctgattgtcacaggctacagaggggccagctccagaacagtgaccagctacatcctgtccaagcagcccgagtgtggtcttggtccctgcagggcaatgtgggcatctggacctggggacgatgtggatgcacttcttggaaagctgttgtagcttgtgcctgtgggtggagaaggcacctgcctggtagactctcagctttctgacccccaggagcctctgcgaggcccctttgtccttggctgagccggacctttcttttggaaatctgtctgtctgttggcatcgctgttttcagaccccaggctgcagaggaggggagaagccacacaacaatctggacccaataaagtggagagaagggcgtctctacacagcccggccagcgtggagggccccaggacagggacccaaaagcttgacgtcactgaacagggctgggtactggcagaacaggaagatttggccagaggtgacctcagtgttccctccaggggcatccaggcccctctgacctggggagaagaaggcccatgctcaggcccacctccctcttcccatcagagcccatgcgtcctgggcaccaccacttccactctgcttttcgaggctccggagggctcttcctgctgtgaaaggaaaggagaagaaagcctgtgggcaatggcaacctctgagtctggcattcttgccaatggctggccagcgaggagaatctcccgagccctgacacacaaaggcattttgtggctgcagaggaaatgggttggctctgaacaaagatgcagtttctagggccgtggccccaaatcgcttccccgagagtgaattttaacactgtaacaataaatactactgcacagcactttaaaaaaaaaaaaaaaaaaaaaaaaaa

SEQ ID NO: 2 - RNA, 23 nt, Artificial Sequence
  Synthetic
agcgcuuaaagggcgagaagauu

SEQ ID NO: 3 - RNA, 23 nt, Artificial Sequence
  Synthetic
ucuucucgcccuuuaagcgcuuu

SEQ ID NO: 4 - RNA, 23 nt, Artificial Sequence
  Synthetic
  misc_feature (2)..(2): 2'-Fluoro
  misc_feature (4)..(4): 2'-Fluoro
  misc_feature (6)..(7): 2'-Fluoro
  misc_feature (11)..(13): 2'-Fluoro
  misc_feature (15)..(15): 2'-Fluoro
  misc_feature (17)..(17): 2'-Fluoro
  misc_feature (20)..(20): 2'-Fluoro
agcgcuuaaagggcgagaagauu

SEQ ID NO: 5 - RNA, 23 nt, Artificial Sequence
  Synthetic
  misc_feature (1)..(1): 2'-O-Methyl
  misc_feature (3)..(4): 2'-O-Methyl
  misc_feature (6)..(6): 2'-O-Methyl
  misc_feature (8)..(8): 2'-O-Methyl
  misc_feature (12)..(14): 2'-O-Methyl
  misc_feature (17)..(17): 2'-O-Methyl
  misc_feature (19)..(19): 2'-O-Methyl
  misc_feature (21)..(23): 2'-O-Methyl
ucuucucgcccuuuaagcgcuuu

SEQ ID NO: 6 - RNA, 23 nt, Artificial Sequence
  Synthetic
  misc_feature (7)..(8): 2'-O-Methyl
agcgcuuaaagggcgagaagauu

SEQ ID NO: 7 - RNA, 23 nt, Artificial Sequence
  Synthetic
  misc_feature (14)..(15): 2'-O-Methyl
ucuucucgcccuuuaagcgcuuu

SEQ ID NO: 8 - RNA, 23 nt, Artificial Sequence
  Synthetic
  misc_feature (7)..(7): 2'-Fluoro
agcgcuuaaagggcgagaagauu

SEQ ID NO: 9 - RNA, 23 nt, Artificial Sequence
  Synthetic
  misc_feature (15)..(15): 2'-O-Methyl
ucuucucgcccuuuaagcgcuuu

SEQ ID NO: 10 - RNA, 23 nt, Artificial Sequence
  Synthetic
  misc_feature (14)..(14): 2'-O-Methyl
ucuucucgcccuuuaagcgcuuu

SEQ ID NO: 11 - RNA, 23 nt, Artificial Sequence
  Synthetic
  misc_feature (8)..(8): 2'-O-Methyl
agcgcuuaaagggcgagaagauu

SEQ ID NO: 12 - RNA, 50 nt, Artificial Sequence
  Synthetic
  misc_feature (24)..(27): n is a, c, g, t or u
agcgcuuaaagggcgagaagauunnnnucuucucgcccuuuaagcgcuuu

SEQ ID NO: 13 - RNA, 50 nt, Artificial Sequence; identical to SEQ ID NO: 12
  Synthetic
  misc_feature (7)..(7): 2'-O-Methyl
  misc_feature (24)..(27): n is a, c, g, t or u
  misc_feature (41)..(41): 2'-O-Methyl

SEQ ID NO: 14 - RNA, 12 nt, Artificial Sequence
  Synthetic
  misc_feature (7)..(7): 2'-O-Methyl
agcgcuuaaagg

SEQ ID NO: 15 - RNA, 11 nt, Artificial Sequence
  Synthetic
gcgagaagauu

SEQ ID NO: 16 - RNA, 22 nt, Artificial Sequence
  Synthetic oligonucleotide - 15RNA
  misc_feature (7)..(7): 2'-O-Methyl
agcgcuuaaagggcggaagauu

SEQ ID NO: 17 - RNA, 22 nt, Artificial Sequence
  Synthetic oligonucleotide - 15RNA
  misc_feature (8)..(8): 2'-Fluoro
agcgcuuaaagggcggaagauu

SEQ ID NO: 18 - RNA, 23 nt, Artificial Sequence
  Synthetic - 13-14phosphodiester
  misc_feature (7)..(7): 2'-O-Methyl
agcgcuuaaagggcgagaagauu

SEQ ID NO: 19 - DNA, 8229 bp, Mus musculus
gcggcaggatacgcgcttgggcgtcgggacgcggctgcgctcagctctctcctctcggaagctgcagccatgatggaagtttgagagttgagccgctgtgaggccaggcccggcgcaggcgagggagatgagagacggcggcggccacggcccagagcccctctcagcgcctgtgagcagccgcgggggcagcgccctcggggagccggccgggcggcggcggcggcagcggcggcgggcctcgcctcctcgtcgtctgttctaaccgggcagcttctgagcagcttcggagagagacggtggaagaagccgtgggctcgagcgggagccggcgcaggctcggcggctgcacctcccgctcctggagcgggggggagaagcggcggcggcggccgcggctccggggagggggtcggagtcgcctgtcaccattgccagggctgggaacgccggagagttgctctctccccttctcctgcctccaacacggcggcggcggcggcggcacgtccagggacccgggccggtgttaagcctcccgtccgccgccgccgcaccccccctggcccgggctccggaggccgccggaggaggcagccgctgcgaggattatccgtcttctccccattccgctgcctcggctgccaggcctctggctgctgaggagaagcaggcccagtctctgcaaccatccagcagccgccgcagcagccattacccggctgcggtccagggccaagcggcagcagagcgaggggcatcagcgaccgccaagtccagagccatttccatcctgcagaagaagcctcgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaatattattgctatgggatttcctgcagaaagacttgaaggtgtatacaggaacaatattgatgatgtagtaaggtttttggattcaaagcataaaaaccattacaagatatacaatctatgtgctgagagacattatgacaccgccaaatttaactgcagagttgcacagtatccttttgaagaccataacccaccacagctagaacttatcaaacccttctgtgaagatcttgaccaatggctaagtgaagatgacaatcatgttgcagcaattcactgtaaagctggaaagggacggactggtgtaatgatttgtgcatatttattgcatcggggcaaatttttaaaggcacaagaggccctagatttttatggggaagtaaggaccagagacaaaaagggagtcacaattcccagtcagaggcgctatgtatattattatagctacctgctaaaaaatcacctggattacagacccgtggcactgctgtttcacaagatgatgtttgaaactattccaatgttcagtggcggaacttgcaatcctcagtttgtggtctgccagctaaaggtgaagatatattcctccaattcaggacccacgcggcgggaggacaagttcatgtactttgagttccctcagccattgcctgtgtgtggtgatatcaaagtagagttcttccacaaacagaacaagatgctcaaaaaggacaaaatgtttcacttttgggtaaatacgttcttcataccaggaccagaggaaacctcagaaaaagtggaaaatggaagtctttgtgatcaggaaatcgatagcatttgcagtatagagcgtgcagataatgacaaggagtatcttgtactcaccctaacaaaaaacgatcttgacaaagcaaacaaagacaaggccaaccgatacttctctccaaattttaaggtgaaactatactttacaaaaacagtagaggagccatcaaatccagaggctagcagttcaacttctgtgactccagatgttagtgacaatgaacctgatcattatagatattctgacaccactgactctgatccagagaatgaaccttttgatgaagatcagcattcacaaattacaaaagtctgattttttttttcttatcaagagggataaaataccatgaaaaaaaaaaaacttgaataaactgaaatggaccttttttttttttttttttttttaaatggcaataggacattgtgtcagattgcagttataggaacaattctcttctcctgaccaatcttgttttaccctatacatccacagggttttgacacttgttgtccagttaaaaaaaggttgtgtagctgtgtcatgtatatacctttttgtgtcaaaaggacatttaaaattcaattaggataaataaaagatggcactttcccattttattccagttttataaaaagtggagacaggctgatgtgtatacgcaggagtttttcctttattttctgtcaccagctgaagtggctgaagagctctgattcccgggttcacgtcctacccctttgcacttgtggcaacagataagtttgcagttggctaaggaagtttctgcagggttttgttagattctaatgcatgcacttgggttgggaatggagggaatgctcagaaaggaatgtttctacctgggctctggaccatacaccatctccagctccttagatgcacctttctttagcatgctccacttactaatctggacatccgagagattggctgctgtcctgctgtttgtttgtgcattttaaagagcatattggtgctagacaaggcagctagagtgagtatatttgtagtggggtacaggaatgaaccatctacagcatcttaagaatccacaaaggaagggatataaaaaaagtggtcatagatagataaaagacacagcagcaatgacttaaccatacaaatgtggaggctttcaacaaaggatgggctggaaacagaaaatttgacaatgatttattcagtatgctttctcagttgtaatgactgctccatctcctatgtaatcaaggccagtgctaagagtcagatgctattagtccctacatcagtcaacaccttacctttatttttattaattttcaatcatatacctactgtggatgcttcatgtgctggctgccagtttgtttttctccttaaatattttataattcttcacaggaaatttcaacttgagattcaacagtaagcaggttttgttttttttttttcctagagattgatgatgcgcgtcctcagtccagtggctgtcagacgttcagcccctttgaccttacacattctattacaatgagttttgcagttttgcacattttttttaaatgtcattaactgttagggaattttacttgaatactgaatacatataatgtgtatattaaaaaagtcattgtttgtgttaaaaaagaaattagagttgcagtaaatttacagcactgcacgaataataaggcattgaagtttttcagtagaaattgtcctacagatgctttatcgacttgctattggaagaatagatcttcttaaatgtgcagtgttgagtcacttcgttatagtggtagagttgggattagggcttcaattttacttcttaaatatcattctatgtttgatatgcccagactgcatacaatttaaagcaagagtacaactactatcgtaatggtaatgtgaagatgctattacaaaggatctcctcccaacccctcgggaatttggtgtctttcaaattatatcttgaccttgacatttgaatatccagccattattagatttcttaatggtgtgaagtcccattttcaataacttattggtgctgaaattgttcactagctgtggtctgacctagttaatttacaagtacagattgcataggacccactagagaagcatttatagtttgatggtaagtagattaggcagaacgccatctaaaatattcttagaaaataatgttgatgtattttccatacctcatcagtttcactcaaccaataaagtttttaaaattgtaacaaagctcttaggatttacacatttatatttaaacattgatacatgaatattgactgactgttgataaagtcagagacaacttttcctgagatctcaccatggaaatctgtacacccccttgtctttcctaaaagctgaaagtggctgactaaaatgcaaagcagctgttgatgttttgaagatagtgataaacactgttctttgttagttttgggcacagcatgctaaactataacttgtattgttccaatatgtaacacagagggccaggtcatgaataatgacattacaatgggctgttgcactgttaatatttttcctttggaatgtgaaggtctgaatgagggttttgattttgaatgtttcagtgtttttgagaagccttgcttacattttatggtgtagtcattggaaatggaaaaatggcattatatatatattatatatatataaatatatatattatacatactctccttactttatttcagttaccatccccatagaatttgacaagaattgctatgactgaaagggttttgagtcctaattcaaactttctttatgacagtattcacgattagcctgaagtgcattctgtaggtgatctctcccgtgtttctggaatgctttcttagactcttggatgtgcagcagcttatgtgtctgaaatgacttgaaggcatcacctttaagaaggcttacagttgggccccgtacatcccaagtcctctgtaattcctcttggacatttttgccataattgtaaaagggtagttgaattaaatagcgtcaccattctttgctgtggcacaggttataaacttaagtggagtttaccggcagcatcaaatgtttcagctttaaaaataaaagtaggttacaagttacatgtttagttttagaaaatttgtgcaatatgttcataacgatggctgtggttgccacaaagtgcctcgtttacctttaaatactgttaatgtgtcgtgcatgcagacggaaggggtggatctgtgcactaaacggggggcttttactctagtattcggcagagttgccttctacctgccagctcaaaagttcgatctgttttcatatagaatatatatactaaaaccatccagtctgtaaaacagccttaccccgattcagcctcttcagatactcttgtgctgtgcagcagtggctctgtgtgtaaatgctatgcactgaggatacacaaatatgacgtgtacaggataatgcctcataccaatcagatgtccatttgttactgtgtttgttaacaaccctttatctcttagtgttataaactccacttaaaactgattaaagtctcattcttgtcattgtgtgggtgttttattaaatgagagtatttataattcaaattgcttaaatccattaaaatgttcagtaatgggcagccacatatgattacaaagttcctgtgcatttttctatttttccccctccttgctatccttccaagcaaagcatctttctgtcatcttggtagacacatacctgtctactcatggttaagaagagcactttaagccttagtcatcacttaataagttattccaggcacagtaaaaagttcaaggttcttggaaaacggtgcttatttctcttcttataagccagatgtctgaagatagccctaaccccaagaacgggcttgatgtctcaggtctgttctgtggctttctgttttttttaacactgcagttggccatcagcacatgggaggtttcatcgggacttgtccagagtagtaggctcaaatatactatctcctttctaatattcttaaaggctaaggagtcctttcaatataacagtaagataacttgtgatgttttagaagtaagcagaccattaatgtcaatgtggagtcttaatgttacatgaagttgatagtttctctgtgacccatttaaaaatacaaaccgagtagcatgcaattatgtaaagaaatatgaagattatatgtagtcacacattttctttagaattcttagtttggtgaaaacttgaatataaaggtattttgatttatatgacattttgatgatatttgaaaaaaaggaatttcctgacattttgcttttagatcatgtcccccattgtgctgtaatttaagccaacttggttcagtgaatgccatcaccatttccattgagaatttaaaactcaccagtgtttaacatgcaggcttctgagggctcccggagaatcagaccttaagcccagttgatttacttctaacgtgaaacttcgagttcctgtatactttgctagataatttgtggtacatctaaagcttagtcttaagtggcttgtgtgtggattttattcaacattcttgttgctagggtagagagaaatgttgctgagtagaaacaagagtacccagttcaatgtggtacagagagcagtccctaaaatctgtacacagtgtaatggaccactttaggagtcaagaggctgatttttcctatgaaattacattgcaacaggaagccttctagtatagttccttttactgttagaatatgtttttatgcatacgctatagctgctttcccatcttccaacaacaggtatcaggatgtaagcaagctttaaacagtgtgaagatggcaggatagtgtcatcggtaacagtcctctgactctaaatgtagttgctctgtaacactttgtgaatataacatcacaattctcatgtccttggggggggggggcatacccagtattagtatgttttagtgactaagcaatcatttttctgtttactcatgtacattttctctttaaaactaaaacctgtactgtgtatgtctccaaagccttttagcttagtttttaggaaatgaacactgaatggatcactttttagtgtagcaggtatgggatatgtgcattatagagagaccttgtcagctctctgggcctatttgaatgtttattgttggtgtgaggatggtaggggaatcagtaaatacaagttacgttggtttagcagagcaagctcagtgtgggtatttctctttgaagcgtggtgcgtgacgcactgtgagtagagaatttggtcaccctttgagtcctcttgcattttgcaaacttgctcagcaaatgcgtacctaccttgccccctaggtaaaagcaggaactactactgatttatctgtcactcagctgtctttatatgtgtgcttctgtgacttgtatcacacaagaatcttaaagatttcacaaattgttaccttttagctctgaatgttgagtattctggtgggctaacaacaagacaaactcttgacagtcatttgagaattttcatgaaacatttagctgaaaacattttataatttatgaaaaaaatgtgttaccttaaacttttacatatgtgggagacattaactgccatatttgagcatactgaattttaaatttaaaataaagctgcatatttttaaatgaaatgtttaacaaggattcatattttttgttttttaagattaaaaataatttatgtcttctcatgtggaacctcatctgtcacaatggttagattatacagaatggagcaaggcttgtagtggtttagcttacagtaaaattcttaatgtttagatgtgtttacttactggctgttatgtatacttttgagattttccacctgttctgtgtagttttctaaatgatactcctacttaaaaacagcattttagtatctattttctgtctccattaaatggtcctcattttctattgagtttggaagtgtgcacattgtgtgtgtgtgtgtgtgtgtgtgtgtgcacacgtgtgcgcgcccgtgcgtgtgtctatttgtggagtttgtatgggagaattagttttgaaagtgctagaatagagatgaaatttggttcaagtaaaattttcccactgggattttacagtttattgtaataaaatgttaattttggatgaccttgaatattaatgaatttgttagcctcttgatgtgtgcattaatgagatatatcaaagttgtatattaaaccaaagttggagttgtggaagtgtttttatgaagttccgtttggctaccaatggacataagactagaaataccttcctgtggagaatatttttcctttaaacaattaaaaaggttcattatttttgaaaaaaaaaaaaaaaaaa

SEQ ID NO: 20 - RNA, 21 nt, Artificial Sequence
  Synthetic
aacccaccacagcuagaacuu

SEQ ID NO: 21 - RNA, 21 nt, Artificial Sequence
  Synthetic
aaguucuagcugugguggguu

SEQ ID NO: 22 - RNA, 21 nt, Artificial Sequence
  Synthetic
  misc_feature (3)..(5): 2'-O-Methyl
  misc_feature (7)..(7): 2'-O-Methyl
  misc_feature (9)..(9): 2'-O-Methyl
  misc_feature (11)..(18): 2'-O-Methyl
  misc_feature (20)..(21): 2'-O-Methyl
aaguucuagcugugguggguu

SEQ ID NO: 23 - RNA, 21 nt, Artificial Sequence
  Synthetic
  misc_feature (1)..(2): 2'-O-Methyl
  misc_feature (6)..(6): 2'-O-Methyl
  misc_feature (9)..(9): 2'-O-Methyl
  misc_feature (11)..(11): 2'-O-Methyl
  misc_feature (14)..(15): 2'-O-Methyl
  misc_feature (17)..(18): 2'-O-Methyl
  misc_feature (20)..(21): 2'-O-Methyl
aacccaccacagcuagaacuu

SEQ ID NO: 24 - RNA, 21 nt, Artificial Sequence
  Synthetic
  misc_feature (14)..(15): 2'-Fluoro
aacccaccacagcuagaacuu

SEQ ID NO: 25 - RNA, 21 nt, Artificial Sequence
  Synthetic
  misc_feature (7)..(8): 2'-Fluoro
aaguucuagcugugguggguu

SEQ ID NO: 26 - RNA, 21 nt, Artificial Sequence
  Synthetic
  misc_feature (14)..(15): 2'-O-Methyl
  misc_feature (20)..(21): 2'-O-Methyl
aacccaccacagcuagaacuu

SEQ ID NO: 27 - RNA, 21 nt, Artificial Sequence
  Synthetic
  misc_feature (4)..(5): 2'-O-Methyl
  misc_feature (7)..(8): 2'-O-Methyl
  misc_feature (11)..(11): 2'-O-Methyl
  misc_feature (13)..(13): 2'-O-Methyl
  misc_feature (16)..(16): 2'-O-Methyl
  misc_feature (20)..(21): 2'-O-Methyl
aaguucuagcugugguggguu

SEQ ID NO: 28 - RNA, 21 nt, Artificial Sequence
  Synthetic
  misc_feature (1)..(2): 2'-O-Methyl
  misc_feature (6)..(6): 2'-O-Methyl
  misc_feature (9)..(9): 2'-O-Methyl
  misc_feature (11)..(11): 2'-O-Methyl
  misc_feature (14)..(15): 2'-O-Methyl
  misc_feature (17)..(18): 2'-O-Methyl
  misc_feature (20)..(21): 2'-O-Methyl
aacccaccacagcuagaacuu

SEQ ID NO: 29 - RNA, 21 nt, Artificial Sequence
  Synthetic
  misc_feature (1)..(2): 2'-O-Methyl
  misc_feature (4)..(5): 2'-O-Methyl
  misc_feature (7)..(8): 2'-O-Methyl
  misc_feature (11)..(11): 2'-O-Methyl
  misc_feature (13)..(13): 2'-O-Methyl
  misc_feature (16)..(16): 2'-O-Methyl
  misc_feature (20)..(21): 2'-O-Methyl
aaguucuagcugugguggguu

SEQ ID NO: 30 - RNA, 21 nt, Artificial Sequence
  Synthetic
  misc_feature (14)..(14): 2'-O-Methyl
  misc_feature (20)..(21): 2'-O-Methyl
aacccaccacagcuagaacuu

SEQ ID NO: 31 - RNA, 21 nt, Artificial Sequence
  Synthetic
  misc_feature (7)..(7): 2'-O-Methyl
aaguucuagcugugguggguu

SEQ ID NO: 32 - RNA, 21 nt, Artificial Sequence
  Synthetic
  misc_feature (1)..(2): 2'-O-Methyl
  misc_feature (6)..(6): 2'-O-Methyl
  misc_feature (9)..(9): 2'-O-Methyl
  misc_feature (11)..(11): 2'-O-Methyl
  misc_feature (14)..(15): 2'-O-Methyl
  misc_feature (17)..(18): 2'-O-Methyl
aacccaccacagcuagaacuu

SEQ ID NO: 33 - RNA, 21 nt, Artificial Sequence
  Synthetic
  misc_feature (12)..(12): 2'-Fluoro
  misc_feature (14)..(16): 2'-Fluoro
aacccaccacagcuagaacuu

SEQ ID NO: 34 - RNA, 21 nt, Artificial Sequence
  Synthetic
  misc_feature (14)..(14): 2'-O-Methyl
aacccaccacagcuagaacuu

SEQ ID NO: 35 - RNA, 23 nt, Artificial Sequence
  Synthetic
  misc_feature (14)..(14): 2'-O-Methyl
  misc_feature (22)..(23): n is a, c, g, t or u
aacccaccacagcuagaacuunn

SEQ ID NO: 36 - RNA, 23 nt, Artificial Sequence
  Synthetic
  misc_feature (22)..(23): n is a, c, g, t or u
uuggguggugucgaucuugaann

SEQ ID NO: 37 - RNA, 21 nt, Artificial Sequence
  Synthetic
  misc_feature (4)..(5): 2'-Fluoro
  misc_feature (7)..(7): 2'-Fluoro
  misc_feature (11)..(11): 2'-Fluoro
  misc_feature (13)..(13): 2'-Fluoro
  misc_feature (16)..(16): 2'-Fluoro
  misc_feature (20)..(21): 2'-Fluoro
aaguucuagcugugguggguu

SEQ ID NO: 38 - RNA, 46 nt, Artificial Sequence
  Synthetic
  misc_feature (14)..(14): 2'-O-Methyl
  misc_feature (22)..(25): n is a, c, g, t or u
aacccaccacagcuagaacuunnnnaaguucuagcugugguggguu

SEQ ID NO: 39 - RNA, 21 nt, Artificial Sequence
  Synthetic
  misc_feature (1)..(2): 2'-O-Methyl
  misc_feature (6)..(6): 2'-O-Methyl
  misc_feature (9)..(9): 2'-O-Methyl
  misc_feature (11)..(11): 2'-O-Methyl
  misc_feature (15)..(15): 2'-O-Methyl
  misc_feature (17)..(18): 2'-O-Methyl
  misc_feature (20)..(21): 2'-O-Methyl
aacccaccacagcuagaacuu

SEQ ID NO: 40 - DNA, 1500 bp, Homo sapiens
gccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataaaaaaaaaaaaaaaaaaaaaaaaaaaa

SEQ ID NO: 41 - RNA, 24 nt, Artificial Sequence
  Synthetic
uuaaugcuaaucgugauagggguu

SEQ ID NO: 42 - RNA, 24 nt, Artificial Sequence
  Synthetic
ccccuaucacgauuagcauuaaua

SEQ ID NO: 43 - RNA, 24 nt, Artificial Sequence
  Synthetic
  misc_feature (1)..(5): 2'-O-Methyl
  misc_feature (8)..(11): 2'-O-Methyl
  misc_feature (14)..(14): 2'-O-Methyl
  misc_feature (16)..(18): 2'-O-Methyl
  misc_feature (20)..(21): 2'-O-Methyl
uuaaugcuaaucgugauagggguu

SEQ ID NO: 44 - RNA, 24 nt, Artificial Sequence
  Synthetic
  misc_feature (5)..(7): 2'-Fluoro
  misc_feature (9)..(9): 2'-Fluoro
  misc_feature (12)..(15): 2'-Fluoro
  misc_feature (18)..(21): 2'-Fluoro
ccccuaucacgauuagcauuaaua

SEQ ID NO: 45 - RNA, 24 nt, Artificial Sequence
  Synthetic
  misc_feature (2)..(2): 2'-O-Methyl
  misc_feature (8)..(8): 2'-O-Methyl
uuaaugcuaaucgugauagggguu

SEQ ID NO: 46 - RNA, 24 nt, Artificial Sequence
  Synthetic
  misc_feature (14)..(14): 2'-O-Methyl
  misc_feature (20)..(20): 2'-O-Methyl
ccccuaucacgauuagcauuaaua

SEQ ID NO: 47 - RNA, 24 nt, Artificial Sequence
  Synthetic
  misc_feature (2)..(2): 2'-O-Methyl
  misc_feature (6)..(6): 2'-O-Methyl
  misc_feature (8)..(8): 2'-O-Methyl
  misc_feature (13)..(13): 2'-O-Methyl
  misc_feature (15)..(15): 2'-O-Methyl
  misc_feature (19)..(22): 2'-O-Methyl
uuaaugcuaaucgugauagggguu

SEQ ID NO: 48 - RNA, 24 nt, Artificial Sequence
  Synthetic
  misc_feature (1)..(2): 2'-Fluoro
  misc_feature (5)..(5): 2'-Fluoro
  misc_feature (8)..(8): 2'-Fluoro
  misc_feature (11)..(11): 2'-Fluoro
  misc_feature (14)..(14): 2'-Fluoro
  misc_feature (17)..(17): 2'-Fluoro
  misc_feature (23)..(24): 2'-Fluoro
uuaaugcuaaucgugauagggguu

SEQ ID NO: 49 - RNA, 24 nt, Artificial Sequence
  Synthetic
  misc_feature (2)..(4): 2'-Fluoro
  misc_feature (8)..(10): 2'-Fluoro
  misc_feature (16)..(16): 2'-Fluoro
  misc_feature (18)..(18): 2'-Fluoro
uuaaugcuaaucgugauagggguu

SEQ ID NO: 50 - RNA, 24 nt, Artificial Sequence
  Synthetic
  misc_feature (2)..(3): 2'-O-Methyl
  misc_feature (8)..(9): 2'-O-Methyl
uuaaugcuaaucgugauagggguu

SEQ ID NO: 51 - RNA, 24 nt, Artificial Sequence
  Synthetic
  misc_feature (5)..(5): 2'-O-Methyl
  misc_feature (7)..(7): 2'-O-Methyl
  misc_feature (13)..(14): 2'-O-Methyl
  misc_feature (19)..(20): 2'-O-Methyl
  misc_feature (23)..(23): 2'-O-Methyl
ccccuaucacgauuagcauuaaua

SEQ ID NO: 52 - RNA, 24 nt, Artificial Sequence
  Synthetic
  misc_feature (2)..(3): 2'-O-Methyl
  misc_feature (6)..(6): 2'-O-Methyl
  misc_feature (8)..(9): 2'-O-Methyl
  misc_feature (13)..(13): 2'-O-Methyl
  misc_feature (15)..(15): 2'-O-Methyl
  misc_feature (19)..(22): 2'-O-Methyl
uuaaugcuaaucgugauagggguu

SEQ ID NO: 53 - RNA, 24 nt, Artificial Sequence
  Synthetic
  misc_feature (14)..(15): 2'-Fluoro
  misc_feature (20)..(21): 2'-Fluoro
ccccuaucacgauuagcauuaaua

SEQ ID NO: 54 - RNA, 24 nt, Artificial Sequence
  Synthetic
  misc_feature (7)..(7): 2'-O-Methyl
  misc_feature (13)..(15): 2'-O-Methyl
  misc_feature (19)..(21): 2'-O-Methyl
  misc_feature (23)..(23): 2'-O-Methyl
ccccuaucacgauuagcauuaaua

SEQ ID NO: 55 - RNA, 24 nt, Artificial Sequence
  Synthetic
  misc_feature (5)..(5): 2'-Fluoro
  misc_feature (7)..(7): 2'-Fluoro
  misc_feature (13)..(15): 2'-Fluoro
  misc_feature (19)..(21): 2'-Fluoro
  misc_feature (23)..(23): 2'-Fluoro
ccccuaucacgauuagcauuaaua

SEQ ID NO: 56 - RNA, 23 nt, Artificial Sequence
  Synthetic
  misc_feature (2)..(2): 2'-O-Methyl
  misc_feature (8)..(8): 2'-O-Methyl
  misc_feature (16)..(16): 2-deoxy
uuaaugcuaaucgugaagggguu

SEQ ID NO: 57 - RNA, 22 nt, Artificial Sequence
  Synthetic
  misc_feature (2)..(2): 2'-O-Methyl
  misc_feature (8)..(8): 2'-O-Methyl
  misc_feature (19)..(19): 2-deoxy
uuaaugcuaaucgugaaggguu

SEQ ID NO: 58 - DNA, 21 bp, Artificial Sequence
  Synthetic
agaaggacuacuaaccucctt

SEQ ID NO: 59 - DNA, 21 bp, Artificial Sequence
  Synthetic
ggagguuaguaguccuucutt

SEQ ID NO: 60 - DNA, 21 bp, Artificial Sequence
  Synthetic
  misc_feature (9)..(9): 2'-O-Methyl
  misc_feature (12)..(12): 2'-O-Methyl
  misc_feature (17)..(17): 2'-O-Methyl
agaaggacuacuaaccucctt

SEQ ID NO: 61 - DNA, 21 bp, Artificial Sequence
  Synthetic
  misc_feature (6)..(7): 2'-O-Methyl
  misc_feature (10)..(10): 2'-O-Methyl
  misc_feature (13)..(13): 2'-O-Methyl
  misc_feature (16)..(17): 2'-O-Methyl
  misc_feature (19)..(19): 2'-O-Methyl
ggagguuaguaguccuucutt

SEQ ID NO: 62 - DNA, 21 bp, Artificial Sequence
  Synthetic
  misc_feature (8)..(9): 2'-O-Methyl
  misc_feature (11)..(12): 2'-O-Methyl
  misc_feature (15)..(19): 2'-O-Methyl
agaaggacuacuaaccucctt

SEQ ID NO: 63 - DNA, 21 bp, Artificial Sequence
  Synthetic
  misc_feature (9)..(9): 2'-O-Methyl
  misc_feature (12)..(12): 2'-O-Methyl
agaaggacuacuaaccucctt

SEQ ID NO: 64 - DNA, 21 bp, Artificial Sequence
  Synthetic
  misc_feature (10)..(10): 2'-O-Methyl
ggagguuaguaguccuucutt

SEQ ID NO: 65 - DNA, 21 bp, Artificial Sequence
  Synthetic
ggacuacuaaccuccaguutt

SEQ ID NO: 66 - DNA, 21 bp, Artificial Sequence
  Synthetic
aacuggagguuaguagucctt

SEQ ID NO: 67 - DNA, 21 bp, Artificial Sequence
  Synthetic
  misc_feature (4)..(5): 2'-O-Methyl
  misc_feature (7)..(8): 2'-O-Methyl
  misc_feature (11)..(15): 2'-O-Methyl
  misc_feature (18)..(19): 2'-O-Methyl
ggacuacuaaccuccaguutt

SEQ ID NO: 68 - DNA, 21 bp, Artificial Sequence
  Synthetic
  misc_feature (3)..(4): 2'-O-Methyl
  misc_feature (10)..(11): 2'-O-Methyl
  misc_feature (14)..(14): 2'-O-Methyl
  misc_feature (17)..(19): 2'-O-Methyl
aacuggagguuaguagucctt

SEQ ID NO: 69 - DNA, 21 bp, Artificial Sequence
  Synthetic
  misc_feature (1)..(3): 2'-O-Methyl
  misc_feature (6)..(6): 2'-O-Methyl
  misc_feature (9)..(10): 2'-O-Methyl
  misc_feature (16)..(17): 2'-O-Methyl
ggacuacuaaccuccaguutt

SEQ ID NO: 70 - DNA, 21 bp, Artificial Sequence
  Synthetic
  misc_feature (5)..(5): 2'-O-Methyl
  misc_feature (8)..(8): 2'-O-Methyl
ggacuacuaaccuccaguutt

SEQ ID NO: 71 - DNA, 21 bp, Artificial Sequence
  Synthetic
  misc_feature (4)..(4): 2'-O-Methyl
  misc_feature (11)..(11): 2'-O-Methyl
  misc_feature (14)..(14): 2'-O-Methyl
aacuggagguuaguagucctt

SEQ ID NO: 72 - DNA, 21 bp, Artificial Sequence
  Synthetic
gaaacugguacuuuccccctt

SEQ ID NO: 73 - DNA, 21 bp, Artificial Sequence
  Synthetic
gggggaaaguaccaguuuctt

SEQ ID NO: 74 - DNA, 21 bp, Artificial Sequence
  Synthetic
  misc_feature (2)..(2): 2'-Fluoro
  misc_feature (4)..(5): 2'-Fluoro
  misc_feature (9)..(9): 2'-Fluoro
  misc_feature (11)..(19): 2'-Fluoro
gaaacugguacuuuccccctt

SEQ ID NO: 75 - DNA, 21 bp, Artificial Sequence
  Synthetic
  misc_feature (10)..(10): 2'-Fluoro
  misc_feature (16)..(18): 2'-Fluoro
gggggaaaguaccaguuuctt

SEQ ID NO: 76 - DNA, 21 bp, Artificial Sequence
  Synthetic
  misc_feature (9)..(9): 2'-Fluoro
gaaacugguacuuuccccctt

SEQ ID NO: 77 - DNA, 21 bp, Artificial Sequence
  Synthetic
  misc_feature (10)..(10): 2'-Fluoro
gggggaaaguaccaguuuctt

SEQ ID NO: 78 - DNA, 21 bp, Artificial Sequence
  Synthetic
uuucccccagguaacgauutt

SEQ ID NO: 79 - DNA, 21 bp, Artificial Sequence
  Synthetic
aaucguuaccugggggaaatt

SEQ ID NO: 80 - DNA, 21 bp, Artificial Sequence
  Synthetic
  misc_feature (4)..(8): 2'-Fluoro
  misc_feature (15)..(15): 2'-Fluoro
uuucccccagguaacgauutt

SEQ ID NO: 81 - DNA, 21 bp, Artificial Sequence
  Synthetic
  misc_feature (4)..(4): 2'-Fluoro
  misc_feature (9)..(10): 2'-Fluoro
aaucguuaccugggggaaatt

SEQ ID NO: 82 - DNA, 21 bp, Artificial Sequence
  Synthetic
  misc_feature (9)..(11): 2'-Fluoro
  misc_feature (13)..(14): 2'-Fluoro
  misc_feature (16)..(17): 2'-Fluoro
uuucccccagguaacgauutt

SEQ ID NO: 83 - DNA, 21 bp, Artificial Sequence
  Synthetic
  misc_feature (12)..(12): 2'-Fluoro
uuucccccagguaacgauutt

SEQ ID NO: 84 - DNA, 21 bp, Artificial Sequence
  Synthetic
  misc_feature (7)..(7): 2'-Fluoro
aaucguuaccugggggaaatt

SEQ ID NO: 85 - DNA, 21 bp, Artificial Sequence
  Synthetic
ccccagguaacgauuuucutt

SEQ ID NO: 86 - DNA, 21 bp, Artificial Sequence
  Synthetic
agaaaaucguuaccuggggtt

SEQ ID NO: 87 - DNA, 21 bp, Artificial Sequence
  Synthetic
  misc_feature (2)..(2): 2'-O-Methyl
  misc_feature (4)..(4): 2'-O-Methyl
  misc_feature (6)..(6): 2'-O-Methyl
  misc_feature (8)..(8): 2'-O-Methyl
  misc_feature (10)..(10): 2'-O-Methyl
  misc_feature (12)..(12): 2'-O-Methyl
  misc_feature (16)..(16): 2'-O-Methyl
ccccagguaacgauuuucutt

SEQ ID NO: 88 - DNA, 21 bp, Artificial Sequence
  Synthetic
  misc_feature (8)..(8): 2'-O-Methyl
  misc_feature (13)..(14): 2'-O-Methyl
agaaaaucguuaccuggggtt

SEQ ID NO: 89 - DNA, 21 bp, Artificial Sequence
  Synthetic
  misc_feature (5)..(7): 2'-O-Methyl
  misc_feature (9)..(9): 2'-O-Methyl
  misc_feature (12)..(13): 2'-O-Methyl
ccccagguaacgauuuucutt

SEQ ID NO: 90 - DNA, 21 bp, Artificial Sequence
  Synthetic
  misc_feature (8)..(8): 2'-O-Methyl
ccccagguaacgauuuucutt

SEQ ID NO: 91 - DNA, 21 bp, Artificial Sequence
  Synthetic
  misc_feature (11)..(11): 2'-O-Methyl
agaaaaucguuaccuggggtt

SEQ ID NO: 92 - DNA, 21 bp, Artificial Sequence
  Synthetic
gggaaacugaaaggcuaugtt

SEQ ID NO: 93 - DNA, 21 bp, Artificial Sequence
  Synthetic
cauagccuuucaguuuccctt

SEQ ID NO: 94 - DNA, 21 bp, Artificial Sequence
  Synthetic
  misc_feature (1)..(1): 2'-Fluoro
  misc_feature (3)..(3): 2'-Fluoro
  misc_feature (6)..(11): 2'-Fluoro
  misc_feature (14)..(19): 2'-Fluoro
cauagccuuucaguuuccctt

SEQ ID NO: 95 - DNA, 21 bp, Artificial Sequence
  Synthetic
  misc_feature (7)..(8): 2'-Fluoro
  misc_feature (15)..(16): 2'-Fluoro
  misc_feature (18)..(18): 2'-Fluoro
gggaaacugaaaggcuaugtt

SEQ ID NO: 96 - DNA, 21 bp, Artificial Sequence
  Synthetic
  misc_feature (16)..(16): 2'-Fluoro
gggaaacugaaaggcuaugtt

SEQ ID NO: 97 - DNA, 21 bp, Artificial Sequence
  Synthetic
gcgagcagagaaucuaccutt

SEQ ID NO: 98 - DNA, 21 bp, Artificial Sequence
  Synthetic
agguagauucucugcucgctt

SEQ ID NO: 99 - DNA, 21 bp, Artificial Sequence
  Synthetic
  misc_feature (1)..(1): 2'-O-Methyl
  misc_feature (3)..(5): 2'-O-Methyl
  misc_feature (7)..(12): 2'-O-Methyl
  misc_feature (16)..(16): 2'-O-Methyl
gcgagcagagaaucuaccutt

SEQ ID NO: 100 - DNA, 21 bp, Artificial Sequence
  Synthetic
  misc_feature (6)..(6): 2'-O-Methyl
  misc_feature (15)..(15): 2'-O-Methyl
gcgagcagagaaucuaccutt

SEQ ID NO: 101 - DNA, 21 bp, Artificial Sequence
  Synthetic
  misc_feature (4)..(4): 2'-O-Methyl
  misc_feature (13)..(13): 2'-O-Methyl
agguagauucucugcucgctt

SEQ ID NO: 102 - DNA, 21 bp, Artificial Sequence
  Synthetic
  misc_feature (15)..(15): 2'-O-Methyl
gcgagcagagaaucuaccutt

SEQ ID NO: 103 - DNA, 21 bp, Artificial Sequence
  Synthetic
  misc_feature (4)..(4): 2'-O-Methyl
agguagauucucugcucgctt

SEQ ID NO: 104 - DNA, 21 bp, Artificial Sequence
  Synthetic
gcagagaaucuaccuuucctt

SEQ ID NO: 105 - DNA, 21 bp, Artificial Sequence
  Synthetic
ggaaagguagauucucugctt

SEQ ID NO: 106 - DNA, 21 bp, Artificial Sequence
  Synthetic
  misc_feature (2)..(2): 2'-O-Methyl
  misc_feature (9)..(11): 2'-O-Methyl
  misc_feature (13)..(19): 2'-O-Methyl
gcagagaaucuaccuuucctt

SEQ ID NO: 107 - DNA, 21 bp, Artificial Sequence
  Synthetic
  misc_feature (8)..(8): 2'-O-Methyl
  misc_feature (12)..(17): 2'-O-Methyl
  misc_feature (19)..(19): 2'-O-Methyl
ggaaagguagauucucugctt

SEQ ID NO: 108 - DNA, 21 bp, Artificial Sequence
  Synthetic
  misc_feature (1)..(1): 2'-O-Methyl
  misc_feature (3)..(8): 2'-O-Methyl
  misc_feature (12)..(12): 2'-O-Methyl
gcagagaaucuaccuuucctt

SEQ ID NO: 109 - DNA, 21 bp, Artificial Sequence
  Synthetic
  misc_feature (2)..(2): 2'-O-Methyl
  misc_feature (11)..(11): 2'-O-Methyl
gcagagaaucuaccuuucctt

SEQ ID NO: 110 - DNA, 21 bp, Artificial Sequence
  Synthetic
  misc_feature (8)..(8): 2'-O-Methyl
  misc_feature (17)..(17): 2'-O-Methyl
ggaaagguagauucucugctt

SEQ ID NO: 111 - DNA, 21 bp, Artificial Sequence
  Synthetic
accuuuccacuucuaagcctt

SEQ ID NO: 112 - DNA, 21 bp, Artificial Sequence
  Synthetic
ggcuuagaaguggaaaggutt

SEQ ID NO: 113 - DNA, 21 bp, Artificial Sequence
  Synthetic
  misc_feature (2)..(8): 2'-O-Methyl
  misc_feature (10)..(14): 2'-O-Methyl
  misc_feature (18)..(19): 2'-O-Methyl
accuuuccacuucuaagcctt

SEQ ID NO: 114 - DNA, 21 bp, Artificial Sequence
  Synthetic
  misc_feature (4)..(5): 2'-O-Methyl
  misc_feature (11)..(11): 2'-O-Methyl
  misc_feature (19)..(19): 2'-O-Methyl
ggcuuagaaguggaaaggutt

SEQ ID NO: 115 - DNA, 21 bp, Artificial Sequence
  Synthetic
  misc_feature (8)..(8): 2'-O-Methyl
  misc_feature (14)..(14): 2'-O-Methyl
accuuuccacuucuaagcctt

SEQ ID NO: 116 - DNA, 21 bp, Artificial Sequence
  Synthetic
  misc_feature (5)..(5): 2'-O-Methyl
  misc_feature (11)..(11): 2'-O-Methyl
ggcuuagaaguggaaaggutt

SEQ ID NO: 117 - DNA, 21 bp, Artificial Sequence
  Synthetic
cuaagccuguuucuuccuctt

SEQ ID NO: 118 - DNA, 21 bp, Artificial Sequence
  Synthetic
gaggaagaaacaggcuuagtt

SEQ ID NO: 119 - DNA, 21 bp, Artificial Sequence
  Synthetic
  misc_feature (2)..(2): 2'-Fluoro
  misc_feature (4)..(4): 2'-Fluoro
  misc_feature (6)..(6): 2'-Fluoro
  misc_feature (8)..(8): 2'-Fluoro
  misc_feature (10)..(10): 2'-Fluoro
  misc_feature (12)..(12): 2'-Fluoro
  misc_feature (14)..(14): 2'-Fluoro
  misc_feature (16)..(16): 2'-Fluoro
  misc_feature (18)..(18): 2'-Fluoro
cuaagccuguuucuuccuctt

SEQ ID NO: 120 - DNA, 21 bp, Artificial Sequence
  Synthetic
  misc_feature (2)..(2): 2'-Fluoro
  misc_feature (5)..(6): 2'-Fluoro
  misc_feature (8)..(10): 2'-Fluoro
  misc_feature (12)..(12): 2'-Fluoro
  misc_feature (18)..(18): 2'-Fluoro
gaggaagaaacaggcuuagtt

SEQ ID NO: 121 - DNA, 21 bp, Artificial Sequence
  Synthetic
  misc_feature (3)..(4): 2'-Fluoro
  misc_feature (10)..(10): 2'-Fluoro
cuaagccuguuucuuccuctt

SEQ ID NO: 122 - DNA, 21 bp, Artificial Sequence
  Synthetic
  misc_feature (17)..(17): 2'-Fluoro
gaggaagaaacaggcuuagtt

SEQ ID NO: 123 - DNA, 21 bp, Artificial Sequence
  Synthetic
  misc_feature (2)..(2): 2'-Fluoro
cuaagccuguuucuuccuctt

SEQ ID NO: 124 - DNA, 21 bp, Artificial Sequence
  Synthetic
gaagauaggaaggggcuuctt

SEQ ID NO: 125 - DNA, 21 bp, Artificial Sequence
  Synthetic
gaagccccuuccuaucuuctt

SEQ ID NO: 126 - DNA, 21 bp, Artificial Sequence
  Synthetic
  misc_feature (5)..(13): 2'-Fluoro
  misc_feature (15)..(19): 2'-Fluoro
gaagccccuuccuaucuuctt

SEQ ID NO: 127 - DNA, 21 bp, Artificial Sequence
  Synthetic
  misc_feature (6)..(6): 2'-Fluoro
  misc_feature (16)..(19): 2'-Fluoro
gaagauaggaaggggcuuctt

SEQ ID NO: 128 - DNA, 21 bp, Artificial Sequence
  Synthetic
  misc_feature (6)..(6): 2'-Fluoro
gaagauaggaaggggcuuctt

SEQ ID NO: 129 - DNA, 21 bp, Artificial Sequence
  Synthetic
  misc_feature (13)..(13): 2'-Fluoro
gaagccccuuccuaucuuctt

SEQ ID NO: 130 - DNA, 21 bp, Artificial Sequence
  Synthetic
aauaagcagcucgcgcucctt

SEQ ID NO: 131 - DNA, 21 bp, Artificial Sequence
  Synthetic
ggagcgcgagcugcuuauutt

SEQ ID NO: 132 - DNA, 21 bp, Artificial Sequence
  Synthetic
  misc_feature (1)..(2): 2'-O-Methyl
  misc_feature (4)..(6): 2'-O-Methyl
  misc_feature (8)..(9): 2'-O-Methyl
  misc_feature (13)..(13): 2'-O-Methyl
  misc_feature (15)..(15): 2'-O-Methyl
aauaagcagcucgcgcucctt

SEQ ID NO: 133 - DNA, 21 bp, Artificial Sequence
  Synthetic
  misc_feature (3)..(3): 2'-O-Methyl
  misc_feature (7)..(7): 2'-O-Methyl
aauaagcagcucgcgcucctt

SEQ ID NO: 134 - DNA, 21 bp, Artificial Sequence
  Synthetic
  misc_feature (12)..(12): 2'-O-Methyl
  misc_feature (16)..(16): 2'-O-Methyl
ggagcgcgagcugcuuauutt

SEQ ID NO: 135 - DNA, 21 bp, Artificial Sequence
  Synthetic
  misc_feature (3)..(3): 2'-O-Methyl
aauaagcagcucgcgcucctt

SEQ ID NO: 136 - DNA, 21 bp, Artificial Sequence
  Synthetic
  misc_feature (16)..(16): 2'-O-Methyl
ggagcgcgagcugcuuauutt

SEQ ID NO: 137 - DNA, 21 bp, Artificial Sequence
  Synthetic
uagccagagccaaagaagctt

SEQ ID NO: 138 - DNA, 21 bp, Artificial Sequence
  Synthetic
gcuucuuuggcucuggcuatt

SEQ ID NO: 139 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (16)..(16): 2'-O-Methyl
uagccagagccaaagaagctt

SEQ ID NO: 140 - DNA, 21 bp, Artificial Sequence
  Synthetic
  misc_feature (3)..(4): 2'-O-Methyl
  misc_feature (6)..(8): 2'-O-Methyl
  misc_feature (12)..(12): 2'-O-Methyl
  misc_feature (14)..(14): 2'-O-Methyl
  misc_feature (18)..(18): 2'-O-Methyl
gcuucuuuggcucuggcuatt

SEQ ID NO: 141 - DNA, 21 bp, Artificial Sequence
  Synthetic
  misc_feature (1)..(1): 2'-O-Methyl
  misc_feature (5)..(5): 2'-O-Methyl
  misc_feature (11)..(11): 2'-O-Methyl
uagccagagccaaagaagctt

SEQ ID NO: 142 - DNA, 21 bp, Artificial Sequence
  Synthetic
  misc_feature (14)..(14): 2'-O-Methyl
  misc_feature (18)..(18): 2'-O-Methyl
gcuucuuuggcucuggcuatt

SEQ ID NO: 143 - DNA, 21 bp, Artificial Sequence
  Synthetic
  misc_feature (1)..(1): 2'-O-Methyl
uagccagagccaaagaagctt

SEQ ID NO: 144 - DNA, 21 bp, Artificial Sequence
  Synthetic
  misc_feature (18)..(18): 2'-O-Methyl
gcuucuuuggcucuggcuatt

SEQ ID NO: 145 - DNA, 21 bp, Artificial Sequence
  Synthetic
aacaguccuuagcuacgcutt

SEQ ID NO: 146 - DNA, 21 bp, Artificial Sequence
  Synthetic
agcguagcuaaggacuguutt

SEQ ID NO: 147 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (12)..(12): 2'-O-Methyl
  misc_feature (14)..(14): 2'-O-Methyl
  misc_feature (17)..(17): 2'-O-Methyl
aacaguccuuagcuacgcutt

SEQ ID NO: 148 - DNA, 21 bp, Artificial Sequence
  Synthetic
  misc_feature (3)..(3): 2'-O-Methyl
  misc_feature (10)..(10): 2'-O-Methyl
  misc_feature (14)..(14): 2'-O-Methyl
  misc_feature (19)..(19): 2'-O-Methyl
aacaguccuuagcuacgcutt

SEQ ID NO: 149 - DNA, 21 bp, Artificial Sequence
  Synthetic
  misc_feature (5)..(5): 2'-O-Methyl
  misc_feature (9)..(9): 2'-O-Methyl
  misc_feature (16)..(16): 2'-O-Methyl
agcguagcuaaggacuguutt

SEQ ID NO: 150 - DNA, 21 bp, Artificial Sequence
  Synthetic
  misc_feature (10)..(10): 2'-O-Methyl
  misc_feature (14)..(14): 2'-O-Methyl
  misc_feature (19)..(19): 2'-O-Methyl
aacaguccuuagcuacgcutt

SEQ ID NO: 151 - DNA, 21 bp, Artificial Sequence
  Synthetic
  misc_feature (5)..(5): 2'-O-Methyl
agcguagcuaaggacuguutt

SEQ ID NO: 152 - DNA, 21 bp, Artificial Sequence
  Synthetic
cuagaggaucuugaagacctt

SEQ ID NO: 153 - DNA, 21 bp, Artificial Sequence
  Synthetic
ggucuucaagauccucuagtt

SEQ ID NO: 154 - DNA, 21 bp, Artificial Sequence
  Synthetic
  misc_feature (1)..(2): 2'-Fluoro
  misc_feature (4)..(4): 2'-Fluoro
  misc_feature (7)..(7): 2'-Fluoro
  misc_feature (9)..(12): 2'-Fluoro
  misc_feature (15)..(15): 2'-Fluoro
  misc_feature (18)..(19): 2'-Fluoro
cuagaggaucuugaagacctt

SEQ ID NO: 155 - DNA, 21 bp, Artificial Sequence
  Synthetic
  misc_feature (3)..(7): 2'-Fluoro
  misc_feature (12)..(17): 2'-Fluoro
ggucuucaagauccucuagtt

SEQ ID NO: 156 - DNA, 21 bp, Artificial Sequence
  Synthetic
  misc_feature (2)..(2): 2'-Fluoro
  misc_feature (12)..(12): 2'-Fluoro
cuagaggaucuugaagacctt

SEQ ID NO: 157 - DNA, 21 bp, Artificial Sequence
  Synthetic
  misc_feature (7)..(7): 2'-Fluoro
  misc_feature (17)..(17): 2'-Fluoro
ggucuucaagauccucuagtt

SEQ ID NO: 158 - DNA, 21 bp, Artificial Sequence
  Synthetic
  misc_feature (3)..(3): 2'-Fluoro
cuagaggaucuugaagacctt

SEQ ID NO: 159 - DNA, 21 bp, Artificial Sequence
  Synthetic
  misc_feature (17)..(17): 2'-Fluoro
ggucuucaagauccucuagtt

SEQ ID NO: 160 - DNA, 21 bp, Artificial Sequence
  Synthetic
aucgaccugaaggaguacgtt

SEQ ID NO: 161 - DNA, 21 bp, Artificial Sequence
  Synthetic
cguacuccuucaggucgautt

SEQ ID NO: 162 - DNA, 21 bp, Artificial Sequence
  Synthetic
  misc_feature (1)..(1): 2'-Fluoro
  misc_feature (4)..(5): 2'-Fluoro
  misc_feature (9)..(15): 2'-Fluoro
  misc_feature (17)..(17): 2'-Fluoro
  misc_feature (19)..(19): 2'-Fluoro
aucgaccugaaggaguacgtt

SEQ ID NO: 163 - DNA, 21 bp, Artificial Sequence
  Synthetic
  misc_feature (2)..(2): 2'-Fluoro
  misc_feature (4)..(4): 2'-Fluoro
  misc_feature (12)..(14): 2'-Fluoro
  misc_feature (17)..(18): 2'-Fluoro
cguacuccuucaggucgautt

SEQ ID NO: 164 - DNA, 21 bp, Artificial Sequence
  Synthetic
  misc_feature (8)..(8): 2'-Fluoro
  misc_feature (16)..(16): 2'-Fluoro
aucgaccugaaggaguacgtt

SEQ ID NO: 165 - DNA, 21 bp, Artificial Sequence
  Synthetic
  misc_feature (3)..(3): 2'-Fluoro
  misc_feature (11)..(11): 2'-Fluoro
cguacuccuucaggucgautt

SEQ ID NO: 166 - DNA, 21 bp, Artificial Sequence
  Synthetic
  misc_feature (16)..(16): 2'-Fluoro
aucgaccugaaggaguacgtt

SEQ ID NO: 167 - DNA, 21 bp, Artificial Sequence
  Synthetic
  misc_feature (4)..(4): 2'-Fluoro
cguacuccuucaggucgautt

SEQ ID NO: 168 - DNA, 21 bp, Artificial Sequence
  Synthetic
gauaggaaggggcuucagctt

SEQ ID NO: 169 - DNA, 21 bp, Artificial Sequence
  Synthetic
gcugaagccccuuccuauctt

SEQ ID NO: 170 - DNA, 21 bp, Artificial Sequence
  Synthetic
  misc_feature (2)..(3): 2'-O-Methyl
  misc_feature (8)..(16): 2'-O-Methyl
  misc_feature (18)..(19): 2'-O-Methyl
gcugaagccccuuccuauctt

SEQ ID NO: 171 - DNA, 21 bp, Artificial Sequence
  Synthetic
  misc_feature (3)..(3): 2'-O-Methyl
  misc_feature (12)..(12): 2'-O-Methyl
  misc_feature (16)..(16): 2'-O-Methyl
gauaggaaggggcuucagctt

SEQ ID NO: 172 - DNA, 21 bp, Artificial Sequence
  Synthetic
  misc_feature (3)..(3): 2'-O-Methyl
  misc_feature (16)..(16): 2'-O-Methyl
gcugaagccccuuccuauctt

SEQ ID NO: 173 - DNA, 21 bp, Artificial Sequence
  Synthetic
  misc_feature (3)..(3): 2'-O-Methyl
gauaggaaggggcuucagctt

SEQ ID NO: 174 - DNA, 21 bp, Artificial Sequence
  Synthetic
  misc_feature (16)..(17): 2'-O-Methyl
gcugaagccccuuccuauctt

SEQ ID NO: 175 - DNA, 21 bp, Artificial Sequence
  Synthetic
agucccuggagccuuaaactt

SEQ ID NO: 176 - DNA, 21 bp, Artificial Sequence
  Synthetic
guuuaaggcuccagggacutt

SEQ ID NO: 177 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agucccuggagccuuaaactt

SEQ ID NO: 178 - DNA, 21 bp, Artificial Sequence
  Synthetic
  misc_feature (7)..(7): 2'-O-Methyl
  misc_feature (15)..(15): 2'-O-Methyl
agucccuggagccuuaaactt

SEQ ID NO: 179 - DNA, 21 bp, Artificial Sequence
  Synthetic
  misc_feature (4)..(4): 2'-O-Methyl
  misc_feature (12)..(12): 2'-O-Methyl
guuuaaggcuccagggacutt

SEQ ID NO: 180 - DNA, 21 bp, Artificial Sequence
  Synthetic
  misc_feature (15)..(16): 2'-O-Methyl
agucccuggagccuuaaactt

SEQ ID NO: 181 - DNA, 21 bp, Artificial Sequence
  Synthetic
  misc_feature (5)..(5): 2'-O-Methyl
guuuaaggcuccagggacutt

SEQ ID NO: 182 - DNA, 21 bp, Artificial Sequence
  Synthetic
agccacauuucuaggagautt

SEQ ID NO: 183 - DNA, 21 bp, Artificial Sequence
  Synthetic
aucuccuagaaauguggcutt

SEQ ID NO: 184 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
agccacauuucuaggagautt

SEQ ID NO: 185 - DNA, 21 bp, Artificial Sequence
  Synthetic
  misc_feature (4)..(4): 2'-O-Methyl
  misc_feature (6)..(6): 2'-O-Methyl
  misc_feature (12)..(12): 2'-O-Methyl
agccacauuucuaggagautt

SEQ ID NO: 186 - DNA, 21 bp, Artificial Sequence
  Synthetic
  misc_feature (7)..(7): 2'-O-Methyl
  misc_feature (13)..(13): 2'-O-Methyl
  misc_feature (15)..(15): 2'-O-Methyl
aucuccuagaaauguggcutt

SEQ ID NO: 187 - DNA, 21 bp, Artificial Sequence
  Synthetic
  misc_feature (4)..(4): 2'-O-Methyl
  misc_feature (13)..(13): 2'-O-Methyl
agccacauuucuaggagautt

SEQ ID NO: 188 - DNA, 21 bp, Artificial Sequence
  Synthetic
  misc_feature (15)..(15): 2'-O-Methyl
aucuccuagaaauguggcutt

SEQ ID NO: 189 - DNA, 21 bp, Artificial Sequence
  Synthetic
gauuccaaaccccacuauctt

SEQ ID NO: 190 - DNA, 21 bp, Artificial Sequence
  Synthetic
gauagugggguuuggaauctt

SEQ ID NO: 191 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gauuccaaaccccacuauctt

SEQ ID NO: 192 - DNA, 21 bp, Artificial Sequence
  Synthetic
  misc_feature (6)..(6): 2'-O-Methyl
  misc_feature (13)..(13): 2'-O-Methyl
  misc_feature (16)..(16): 2'-O-Methyl
gauuccaaaccccacuauctt

SEQ ID NO: 193 - DNA, 21 bp, Artificial Sequence
  Synthetic
  misc_feature (13)..(13): 2'-O-Methyl
gauagugggguuuggaauctt

SEQ ID NO: 194 - DNA, 21 bp, Artificial Sequence
  Synthetic
  misc_feature (16)..(16): 2'-O-Methyl
gauuccaaaccccacuauctt

SEQ ID NO: 195 - DNA, 21 bp, Artificial Sequence
  Synthetic
  misc_feature (4)..(4): 2'-O-Methyl
gauagugggguuuggaauctt

SEQ ID NO: 196 - DNA, 21 bp, Artificial Sequence
  Synthetic
gauacuucugguucccucctt

SEQ ID NO: 197 - DNA, 21 bp, Artificial Sequence
  Synthetic
ggagggaaccagaaguauctt

SEQ ID NO: 198 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gauacuucugguucccucctt

SEQ ID NO: 199 - DNA, 21 bp, Artificial Sequence
  Synthetic
  misc_feature (3)..(3): 2'-O-Methyl
  misc_feature (9)..(9): 2'-O-Methyl
gauacuucugguucccucctt

SEQ ID NO: 200 - DNA, 21 bp, Artificial Sequence
  Synthetic
  misc_feature (10)..(10): 2'-O-Methyl
  misc_feature (16)..(16): 2'-O-Methyl
ggagggaaccagaaguauctt

SEQ ID NO: 201 - DNA, 21 bp, Artificial Sequence
  Synthetic
  misc_feature (3)..(3): 2'-O-Methyl
gauacuucugguucccucctt

SEQ ID NO: 202 - DNA, 21 bp, Artificial Sequence
  Synthetic
  misc_feature (16)..(16): 2'-O-Methyl
ggagggaaccagaaguauctt

SEQ ID NO: 203 - DNA, 21 bp, Artificial Sequence
  Synthetic
agagaagggcgucucuacatt

SEQ ID NO: 204 - DNA, 21 bp, Artificial Sequence
  Synthetic
uguagagacgcccuucucutt

SEQ ID NO: 205 - DNA, 21 bp, Artificial Sequence
  Synthetic
  misc_feature (1)..(1): 2'-Fluoro
  misc_feature (4)..(4): 2'-Fluoro
  misc_feature (6)..(6): 2'-Fluoro
  misc_feature (8)..(9): 2'-Fluoro
  misc_feature (12)..(12): 2'-Fluoro
  misc_feature (16)..(16): 2'-Fluoro
  misc_feature (18)..(18): 2'-Fluoro
agagaagggcgucucuacatt

SEQ ID NO: 206 - DNA, 21 bp, Artificial Sequence
  Synthetic
  misc_feature (10)..(10): 2'-Fluoro
  misc_feature (16)..(16): 2'-Fluoro
  misc_feature (18)..(18): 2'-Fluoro
agagaagggcgucucuacatt

SEQ ID NO: 207 - DNA, 21 bp, Artificial Sequence
  Synthetic
  misc_feature (1)..(1): 2'-Fluoro
  misc_feature (3)..(3): 2'-Fluoro
uguagagacgcccuucucutt

SEQ ID NO: 208 - DNA, 21 bp, Artificial Sequence
  Synthetic
  misc_feature (17)..(17): 2'-Fluoro
agagaagggcgucucuacatt

SEQ ID NO: 209 - DNA, 21 bp, Artificial Sequence
  Synthetic
  misc_feature (3)..(3): 2'-Fluoro
uguagagacgcccuucucutt

SEQ ID NO: 210 - DNA, 21 bp, Artificial Sequence
  Synthetic
aguuucuagggccguggcctt

SEQ ID NO: 211 - DNA, 21 bp, Artificial Sequence
  Synthetic
ggccacggcccuagaaacutt

SEQ ID NO: 212 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(12): 2'-Fluoro
  misc_feature (14)..(14): 2'-Fluoro
  misc_feature (17)..(17): 2'-Fluoro
aguuucuagggccguggcctt

SEQ ID NO: 213 - DNA, 21 bp, Artificial Sequence
  Synthetic
  misc_feature (7)..(7): 2'-Fluoro
  misc_feature (15)..(15): 2'-Fluoro
aguuucuagggccguggcctt

SEQ ID NO: 214 - DNA, 21 bp, Artificial Sequence
  Synthetic
  misc_feature (4)..(4): 2'-Fluoro
  misc_feature (8)..(8): 2'-Fluoro
  misc_feature (12)..(12): 2'-Fluoro
ggccacggcccuagaaacutt

SEQ ID NO: 215 - DNA, 21 bp, Artificial Sequence
  Synthetic
  misc_feature (7)..(8): 2'-Fluoro
aguuucuagggccguggcctt

SEQ ID NO: 216 - DNA, 21 bp, Artificial Sequence
  Synthetic
  misc_feature (12)..(12): 2'-Fluoro
ggccacggcccuagaaacutt

SEQ ID NO: 217 - DNA, 2413 bp, Homo sapiens
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctatt

SEQ ID NO: 218 - DNA, 21 bp, Artificial Sequence
  Synthetic
gaagaguuaacccgggacutt

SEQ ID NO: 219 - DNA, 21 bp, Artificial Sequence
  Synthetic
agucccggguuaacucuuctt

SEQ ID NO: 220 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
gaagaguuaacccgggacutt

SEQ ID NO: 221 - DNA, 21 bp, Artificial Sequence
  Synthetic
  misc_feature (8)..(8): 2'-O-Methyl
  misc_feature (14)..(14): 2'-O-Methyl
  misc_feature (17)..(17): 2'-O-Methyl
gaagaguuaacccgggacutt

SEQ ID NO: 222 - DNA, 21 bp, Artificial Sequence
  Synthetic
  misc_feature (11)..(11): 2'-O-Methyl
agucccggguuaacucuuctt

SEQ ID NO: 223 - DNA, 21 bp, Artificial Sequence
  Synthetic
  misc_feature (8)..(8): 2'-O-Methyl
gaagaguuaacccgggacutt

SEQ ID NO: 224 - DNA, 21 bp, Artificial Sequence
  Synthetic
  misc_feature (1)..(1): 2'-O-Methyl
agucccggguuaacucuuctt

SEQ ID NO: 225 - DNA, 21 bp, Artificial Sequence
  Synthetic
ccgcccggcggcgccuuuatt

SEQ ID NO: 226 - DNA, 21 bp, Artificial Sequence
  Synthetic
uaaaggcgccgccgggcggtt

SEQ ID NO: 227 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ccgcccggcggcgccuuuatt

SEQ ID NO: 228 - DNA, 21 bp, Artificial Sequence
  Synthetic
  misc_feature (13)..(13): 2'-O-Methyl
  misc_feature (18)..(19): 2'-O-Methyl
ccgcccggcggcgccuuuatt

SEQ ID NO: 229 - DNA, 21 bp, Artificial Sequence
  Synthetic
  misc_feature (1)..(2): 2'-O-Methyl
uaaaggcgccgccgggcggtt

SEQ ID NO: 230 - DNA, 21 bp, Artificial Sequence
  Synthetic
  misc_feature (19)..(19): 2'-O-Methyl
ccgcccggcggcgccuuuatt

SEQ ID NO: 231 - DNA, 21 bp, Artificial Sequence
  Synthetic
  misc_feature (1)..(2): 2'-O-Methyl
uaaaggcgccgccgggcggtt

SEQ ID NO: 232 - DNA, 21 bp, Artificial Sequence
  Synthetic
accgacgauucuucuacuctt

SEQ ID NO: 233 - DNA, 21 bp, Artificial Sequence
  Synthetic
gaguagaagaaucgucggutt

SEQ ID NO: 234 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
accgacgauucuucuacuctt

SEQ ID NO: 235 - DNA, 21 bp, Artificial Sequence
  Synthetic
  misc_feature (15)..(15): 2'-O-Methyl
accgacgauucuucuacuctt

SEQ ID NO: 236 - DNA, 21 bp, Artificial Sequence
  Synthetic
  misc_feature (4)..(4): 2'-O-Methyl
  misc_feature (10)..(11): 2'-O-Methyl
gaguagaagaaucgucggutt

SEQ ID NO: 237 - DNA, 21 bp, Artificial Sequence
  Synthetic
  misc_feature (4)..(4): 2'-O-Methyl
gaguagaagaaucgucggutt

SEQ ID NO: 238 - DNA, 21 bp, Artificial Sequence
  Synthetic
gguagaauagguuuucccctt

SEQ ID NO: 239 - DNA, 21 bp, Artificial Sequence
  Synthetic
ggggaaaaccuauucuacctt

SEQ ID NO: 240 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gguagaauagguuuucccctt

SEQ ID NO: 241 - DNA, 21 bp, Artificial Sequence
  Synthetic
  misc_feature (3)..(4): 2'-O-Methyl
  misc_feature (8)..(8): 2'-O-Methyl
gguagaauagguuuucccctt

SEQ ID NO: 242 - DNA, 21 bp, Artificial Sequence
  Synthetic
  misc_feature (11)..(11): 2'-O-Methyl
  misc_feature (16)..(16): 2'-O-Methyl
ggggaaaaccuauucuacctt

SEQ ID NO: 243 - DNA, 21 bp, Artificial Sequence
  Synthetic
  misc_feature (3)..(3): 2'-O-Methyl
gguagaauagguuuucccctt

SEQ ID NO: 244 - DNA, 21 bp, Artificial Sequence
  Synthetic
  misc_feature (11)..(11): 2'-O-Methyl
ggggaaaaccuauucuacctt

SEQ ID NO: 245 - DNA, 21 bp, Artificial Sequence
  Synthetic
ucccuuccaccgccauauutt

SEQ ID NO: 246 - DNA, 21 bp, Artificial Sequence
  Synthetic
aauauggcgguggaagggatt

SEQ ID NO: 247 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ucccuuccaccgccauauutt

SEQ ID NO: 248 - DNA, 21 bp, Artificial Sequence
  Synthetic
  misc_feature (8)..(8): 2'-O-Methyl
  misc_feature (14)..(14): 2'-O-Methyl
  misc_feature (16)..(16): 2'-O-Methyl
ucccuuccaccgccauauutt

SEQ ID NO: 249 - DNA, 21 bp, Artificial Sequence
  Synthetic
  misc_feature (3)..(3): 2'-O-Methyl
  misc_feature (5)..(5): 2'-O-Methyl
  misc_feature (11)..(11): 2'-O-Methyl
aauauggcgguggaagggatt

SEQ ID NO: 250 - DNA, 21 bp, Artificial Sequence
  Synthetic
  misc_feature (16)..(16): 2'-O-Methyl
ucccuuccaccgccauauutt

SEQ ID NO: 251 - DNA, 21 bp, Artificial Sequence
  Synthetic
  misc_feature (3)..(3): 2'-O-Methyl
aauauggcgguggaagggatt

SEQ ID NO: 252 - DNA, 21 bp, Artificial Sequence
  Synthetic
cgagugucuaacgggagcctt

SEQ ID NO: 253 - DNA, 21 bp, Artificial Sequence
  Synthetic
ggcucccguuagacacucgtt

SEQ ID NO: 254 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cgagugucuaacgggagcctt

SEQ ID NO: 255 - DNA, 21 bp, Artificial Sequence
  Synthetic
  misc_feature (5)..(5): 2'-O-Methyl
  misc_feature (9)..(9): 2'-O-Methyl
cgagugucuaacgggagcctt

SEQ ID NO: 256 - DNA, 21 bp, Artificial Sequence
  Synthetic
  misc_feature (10)..(10): 2'-O-Methyl
  misc_feature (14)..(14): 2'-O-Methyl
ggcucccguuagacacucgtt

SEQ ID NO: 257 - DNA, 21 bp, Artificial Sequence
  Synthetic
  misc_feature (10)..(10): 2'-O-Methyl
ggcucccguuagacacucgtt

SEQ ID NO: 258 - DNA, 21 bp, Artificial Sequence
  Synthetic
gaccacgaagaguuaaccctt

SEQ ID NO: 259 - DNA, 21 bp, Artificial Sequence
  Synthetic
ggguuaacucuucgugguctt

SEQ ID NO: 260 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
gaccacgaagaguuaaccctt

SEQ ID NO: 261 - DNA, 21 bp, Artificial Sequence
  Synthetic
  misc_feature (4)..(4): 2'-Fluoro
  misc_feature (14)..(14): 2'-Fluoro
gaccacgaagaguuaaccctt

SEQ ID NO: 262 - DNA, 21 bp, Artificial Sequence
  Synthetic
  misc_feature (5)..(5): 2'-Fluoro
  misc_feature (15)..(15): 2'-Fluoro
ggguuaacucuucgugguctt

SEQ ID NO: 263 - DNA, 21 bp, Artificial Sequence
  Synthetic
  misc_feature (14)..(14): 2'-Fluoro
gaccacgaagaguuaaccctt

SEQ ID NO: 264 - DNA, 21 bp, Artificial Sequence
  Synthetic
  misc_feature (5)..(5): 2'-Fluoro
ggguuaacucuucgugguctt

SEQ ID NO: 265 - DNA, 21 bp, Artificial Sequence
  Synthetic
aguuaacccgggacuuggatt

SEQ ID NO: 266 - DNA, 21 bp, Artificial Sequence
  Synthetic
uccaagucccggguuaacutt

SEQ ID NO: 267 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
aguuaacccgggacuuggatt

SEQ ID NO: 268 - DNA, 21 bp, Artificial Sequence
  Synthetic
  misc_feature (4)..(4): 2'-Fluoro
  misc_feature (16)..(16): 2'-Fluoro
aguuaacccgggacuuggatt

SEQ ID NO: 269 - DNA, 21 bp, Artificial Sequence
  Synthetic
  misc_feature (3)..(3): 2'-Fluoro
  misc_feature (15)..(15): 2'-Fluoro
uccaagucccggguuaacutt

SEQ ID NO: 270 - DNA, 21 bp, Artificial Sequence
  Synthetic
  misc_feature (4)..(4): 2'-Fluoro
aguuaacccgggacuuggatt

SEQ ID NO: 271 - DNA, 21 bp, Artificial Sequence
  Synthetic
  misc_feature (3)..(3): 2'-Fluoro
  misc_feature (15)..(15): 2'-Fluoro
uccaagucccggguuaacutt

SEQ ID NO: 272 - DNA, 21 bp, Artificial Sequence
  Synthetic
aucacaaaccccuagagggtt

SEQ ID NO: 273 - DNA, 21 bp, Artificial Sequence
  Synthetic
cccucuagggguuugugautt

SEQ ID NO: 274 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aucacaaaccccuagagggtt

SEQ ID NO: 275 - DNA, 21 bp, Artificial Sequence
  Synthetic
  misc_feature (3)..(3): 2'-O-Methyl
  misc_feature (5)..(5): 2'-O-Methyl
  misc_feature (13)..(13): 2'-O-Methyl
aucacaaaccccuagagggtt

SEQ ID NO: 276 - DNA, 21 bp, Artificial Sequence
  Synthetic
  misc_feature (6)..(6): 2'-O-Methyl
  misc_feature (14)..(14): 2'-O-Methyl
  misc_feature (16)..(16): 2'-O-Methyl
cccucuagggguuugugautt

SEQ ID NO: 277 - DNA, 21 bp, Artificial Sequence
  Synthetic
  misc_feature (13)..(13): 2'-O-Methyl
aucacaaaccccuagagggtt

SEQ ID NO: 278 - DNA, 21 bp, Artificial Sequence
  Synthetic
  misc_feature (6)..(6): 2'-O-Methyl
cccucuagggguuugugautt

SEQ ID NO: 279 - DNA, 21 bp, Artificial Sequence
  Synthetic
aaaccccuagagggcaagutt

SEQ ID NO: 280 - DNA, 21 bp, Artificial Sequence
  Synthetic
acuugcccucuagggguuutt

SEQ ID NO: 281 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaaccccuagagggcaagutt

SEQ ID NO: 282 - DNA, 21 bp, Artificial Sequence
  Synthetic
  misc_feature (8)..(8): 2'-O-Methyl
  misc_feature (15)..(15): 2'-O-Methyl
aaaccccuagagggcaagutt

SEQ ID NO: 283 - DNA, 21 bp, Artificial Sequence
  Synthetic
  misc_feature (4)..(4): 2'-O-Methyl
  misc_feature (11)..(11): 2'-O-Methyl
acuugcccucuagggguuutt

SEQ ID NO: 284 - DNA, 21 bp, Artificial Sequence
  Synthetic
  misc_feature (8)..(8): 2'-O-Methyl
aaaccccuagagggcaagutt

SEQ ID NO: 285 - DNA, 21 bp, Artificial Sequence
  Synthetic
  misc_feature (11)..(11): 2'-O-Methyl
acuugcccucuagggguuutt

SEQ ID NO: 286 - DNA, 21 bp, Artificial Sequence
  Synthetic
uccggcuaacucugaggactt

SEQ ID NO: 287 - DNA, 21 bp, Artificial Sequence
  Synthetic
guccucagaguuagccggatt

SEQ ID NO: 288 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uccggcuaacucugaggactt

SEQ ID NO: 289 - DNA, 21 bp, Artificial Sequence
  Synthetic
  misc_feature (7)..(7): 2'-Fluoro
  misc_feature (13)..(13): 2'-Fluoro
uccggcuaacucugaggactt

SEQ ID NO: 290 - DNA, 21 bp, Artificial Sequence
  Synthetic
  misc_feature (6)..(6): 2'-Fluoro
  misc_feature (12)..(12): 2'-Fluoro
guccucagaguuagccggatt

SEQ ID NO: 291 - DNA, 21 bp, Artificial Sequence
  Synthetic
  misc_feature (7)..(7): 2'-Fluoro
uccggcuaacucugaggactt

SEQ ID NO: 292 - DNA, 21 bp, Artificial Sequence
  Synthetic
  misc_feature (12)..(12): 2'-Fluoro
guccucagaguuagccggatt

SEQ ID NO: 293 - DNA, 21 bp, Artificial Sequence
  Synthetic
cgacgauucuucuacucaatt

SEQ ID NO: 294 - DNA, 21 bp, Artificial Sequence
  Synthetic
uugaguagaagaaucgucgtt

SEQ ID NO: 295 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cgacgauucuucuacucaatt

SEQ ID NO: 296 - DNA, 21 bp, Artificial Sequence
  Synthetic
  misc_feature (5)..(5): 2'-Fluoro
  misc_feature (13)..(13): 2'-Fluoro
cgacgauucuucuacucaatt

SEQ ID NO: 297 - DNA, 21 bp, Artificial Sequence
  Synthetic
  misc_feature (2)..(2): 2'-Fluoro
  misc_feature (6)..(6): 2'-Fluoro
uugaguagaagaaucgucgtt

SEQ ID NO: 298 - DNA, 21 bp, Artificial Sequence
  Synthetic
  misc_feature (13)..(13): 2'-Fluoro
cgacgauucuucuacucaatt

SEQ ID NO: 299 - DNA, 21 bp, Artificial Sequence
  Synthetic
  misc_feature (6)..(6): 2'-Fluoro
uugaguagaagaaucgucgtt

SEQ ID NO: 300 - DNA, 21 bp, Artificial Sequence
  Synthetic
uaaacuuuggggaagggagtt

SEQ ID NO: 301 - DNA, 21 bp, Artificial Sequence
  Synthetic
cucccuuccccaaaguuuatt

SEQ ID NO: 302 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uaaacuuuggggaagggagtt

SEQ ID NO: 303 - DNA, 21 bp, Artificial Sequence
  Synthetic
  misc_feature (1)..(1): 2'-O-Methyl
  misc_feature (8)..(8): 2'-O-Methyl
uaaacuuuggggaagggagtt

SEQ ID NO: 304 - DNA, 21 bp, Artificial Sequence
  Synthetic
  misc_feature (11)..(11): 2'-O-Methyl
  misc_feature (18)..(18): 2'-O-Methyl
cucccuuccccaaaguuuatt

SEQ ID NO: 305 - DNA, 21 bp, Artificial Sequence
  Synthetic
  misc_feature (1)..(1): 2'-O-Methyl
uaaacuuuggggaagggagtt

SEQ ID NO: 306 - DNA, 21 bp, Artificial Sequence
  Synthetic
  misc_feature (18)..(18): 2'-O-Methyl
cucccuuccccaaaguuuatt

SEQ ID NO: 307 - DNA, 21 bp, Artificial Sequence
  Synthetic
agcgggguaugaagagcuutt

SEQ ID NO: 308 - DNA, 21 bp, Artificial Sequence
  Synthetic
aagcucuucauaccccgcutt

SEQ ID NO: 309 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agcgggguaugaagagcuutt

SEQ ID NO: 310 - DNA, 21 bp, Artificial Sequence
  Synthetic
  misc_feature (8)..(8): 2'-O-Methyl
  misc_feature (10)..(10): 2'-O-Methyl
  misc_feature (15)..(15): 2'-O-Methyl
agcgggguaugaagagcuutt

SEQ ID NO: 311 - DNA, 21 bp, Artificial Sequence
  Synthetic
  misc_feature (9)..(9): 2'-O-Methyl
  misc_feature (11)..(11): 2'-O-Methyl
aagcucuucauaccccgcutt

SEQ ID NO: 312 - DNA, 21 bp, Artificial Sequence
  Synthetic
  misc_feature (8)..(8): 2'-O-Methyl
agcgggguaugaagagcuutt

SEQ ID NO: 313 - DNA, 21 bp, Artificial Sequence
  Synthetic
  misc_feature (11)..(11): 2'-O-Methyl
aagcucuucauaccccgcutt

SEQ ID NO: 314 - DNA, 21 bp, Artificial Sequence
  Synthetic
cuccccagucucucuuaaatt

SEQ ID NO: 315 - DNA, 21 bp, Artificial Sequence
  Synthetic
uuuaagagagacuggggagtt

SEQ ID NO: 316 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cuccccagucucucuuaaatt

SEQ ID NO: 317 - DNA, 21 bp, Artificial Sequence
  Synthetic
  misc_feature (4)..(4): 2'-O-Methyl
  misc_feature (6)..(6): 2'-O-Methyl
  misc_feature (10)..(10): 2'-O-Methyl
  misc_feature (16)..(16): 2'-O-Methyl
cuccccagucucucuuaaatt

SEQ ID NO: 318 - DNA, 21 bp, Artificial Sequence
  Synthetic
  misc_feature (3)..(3): 2'-O-Methyl
  misc_feature (13)..(13): 2'-O-Methyl
uuuaagagagacuggggagtt

SEQ ID NO: 319 - DNA, 21 bp, Artificial Sequence
  Synthetic
  misc_feature (17)..(17): 2'-O-Methyl
cuccccagucucucuuaaatt

SEQ ID NO: 320 - DNA, 21 bp, Artificial Sequence
  Synthetic
  misc_feature (4)..(4): 2'-O-Methyl
uuuaagagagacuggggagtt

SEQ ID NO: 321 - DNA, 600 bp, Pan troglodytes
atgaagcacagcctccccgacctgccctacgactacggcgccctggaacctcacatcaacgcgcagatcatgcagctgcaccacagcaagcaccacgcggcctacgtgaataacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaa

SEQ ID NO: 322 - DNA, 21 bp, Artificial Sequence
  Synthetic
gaauaaccugaacgucacctt

SEQ ID NO: 323 - DNA, 21 bp, Artificial Sequence
  Synthetic
ggugacguucagguuauuctt

SEQ ID NO: 324 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaauaaccugaacgucacctt

SEQ ID NO: 325 - DNA, 21 bp, Artificial Sequence
  Synthetic
  misc_feature (4)..(4): 2'-O-Methyl
  misc_feature (9)..(9): 2'-O-Methyl
  misc_feature (16)..(16): 2'-O-Methyl
gaauaaccugaacgucacctt

SEQ ID NO: 326 - DNA, 21 bp, Artificial Sequence
  Synthetic
  misc_feature (3)..(3): 2'-O-Methyl
  misc_feature (10)..(10): 2'-O-Methyl
  misc_feature (15)..(15): 2'-O-Methyl
ggugacguucagguuauuctt

SEQ ID NO: 327 - DNA, 21 bp, Artificial Sequence
  Synthetic
  misc_feature (4)..(4): 2'-O-Methyl
gaauaaccugaacgucacctt

SEQ ID NO: 328 - DNA, 21 bp, Artificial Sequence
  Synthetic
  misc_feature (15)..(15): 2'-O-Methyl
ggugacguucagguuauuctt

SEQ ID NO: 329 - DNA, 21 bp, Artificial Sequence
  Synthetic
acgucaccgaggagaaguatt

SEQ ID NO: 330 - DNA, 21 bp, Artificial Sequence
  Synthetic
uacuucuccucggugacgutt

SEQ ID NO: 331 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
acgucaccgaggagaaguatt

SEQ ID NO: 332 - DNA, 21 bp, Artificial Sequence
  Synthetic
  misc_feature (5)..(5): 2'-O-Methyl
  misc_feature (18)..(18): 2'-O-Methyl
acgucaccgaggagaaguatt

SEQ ID NO: 333 - DNA, 21 bp, Artificial Sequence
  Synthetic
  misc_feature (14)..(14): 2'-O-Methyl
uacuucuccucggugacgutt

SEQ ID NO: 334 - DNA, 21 bp, Artificial Sequence
  Synthetic
  misc_feature (18)..(18): 2'-O-Methyl
acgucaccgaggagaaguatt

SEQ ID NO: 335 - DNA, 21 bp, Artificial Sequence
  Synthetic
agaaguaccaggaggcguutt

SEQ ID NO: 336 - DNA, 21 bp, Artificial Sequence
  Synthetic
aacgccuccugguacuucutt

SEQ ID NO: 337 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agaaguaccaggaggcguutt

SEQ ID NO: 338 - DNA, 21 bp, Artificial Sequence
  Synthetic
  misc_feature (6)..(6): 2'-O-Methyl
  misc_feature (9)..(9): 2'-O-Methyl
  misc_feature (15)..(15): 2'-O-Methyl
agaaguaccaggaggcguutt

SEQ ID NO: 339 - DNA, 21 bp, Artificial Sequence
  Synthetic
  misc_feature (10)..(10): 2'-O-Methyl
  misc_feature (13)..(13): 2'-O-Methyl
aacgccuccugguacuucutt

SEQ ID NO: 340 - DNA, 21 bp, Artificial Sequence
  Synthetic
  misc_feature (6)..(6): 2'-O-Methyl
agaaguaccaggaggcguutt

SEQ ID NO: 341 - DNA, 21 bp, Artificial Sequence
  Synthetic
  misc_feature (13)..(13): 2'-O-Methyl
aacgccuccugguacuucutt

SEQ ID NO: 342 - DNA, 21 bp, Artificial Sequence
  Synthetic
agcccagauagcucuucagtt

SEQ ID NO: 343 - DNA, 21 bp, Artificial Sequence
  Synthetic
cugaagagcuaucugggcutt

SEQ ID NO: 344 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
agcccagauagcucuucagtt

SEQ ID NO: 345 - DNA, 21 bp, Artificial Sequence
  Synthetic
  misc_feature (5)..(5): 2'-Fluoro
  misc_feature (9)..(9): 2'-Fluoro
  misc_feature (17)..(17): 2'-Fluoro
agcccagauagcucuucagtt

SEQ ID NO: 346 - DNA, 21 bp, Artificial Sequence
  Synthetic
  misc_feature (2)..(2): 2'-Fluoro
  misc_feature (10)..(10): 2'-Fluoro
  misc_feature (14)..(14): 2'-Fluoro
cugaagagcuaucugggcutt

SEQ ID NO: 347 - DNA, 21 bp, Artificial Sequence
  Synthetic
  misc_feature (9)..(9): 2'-Fluoro
agcccagauagcucuucagtt

SEQ ID NO: 348 - DNA, 21 bp, Artificial Sequence
  Synthetic
  misc_feature (10)..(10): 2'-Fluoro
cugaagagcuaucugggcutt

SEQ ID NO: 349 - DNA, 21 bp, Artificial Sequence
  Synthetic
aaaccucagcccuaacggutt

SEQ ID NO: 350 - DNA, 21 bp, Artificial Sequence
  Synthetic
accguuagggcugagguuutt

SEQ ID NO: 351 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaaccucagcccuaacggutt

SEQ ID NO: 352 - DNA, 21 bp, Artificial Sequence
  Synthetic
  misc_feature (5)..(5): 2'-O-Methyl
  misc_feature (7)..(7): 2'-O-Methyl
  misc_feature (13)..(13): 2'-O-Methyl
aaaccucagcccuaacggutt

SEQ ID NO: 353 - DNA, 21 bp, Artificial Sequence
  Synthetic
  misc_feature (6)..(6): 2'-O-Methyl
  misc_feature (12)..(12): 2'-O-Methyl
accguuagggcugagguuutt

SEQ ID NO: 354 - DNA, 21 bp, Artificial Sequence
  Synthetic
  misc_feature (13)..(14): 2'-O-Methyl
aaaccucagcccuaacggutt

SEQ ID NO: 355 - DNA, 21 bp, Artificial Sequence
  Synthetic
  misc_feature (6)..(6): 2'-O-Methyl
accguuagggcugagguuutt

SEQ ID NO: 356 - DNA, 21 bp, Artificial Sequence
  Synthetic
uuaaggagaagcugacggctt

SEQ ID NO: 357 - DNA, 21 bp, Artificial Sequence
  Synthetic
gccgucagcuucuccuuaatt

SEQ ID NO: 358 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuaaggagaagcugacggctt

SEQ ID NO: 359 - DNA, 21 bp, Artificial Sequence
  Synthetic
  misc_feature (2)..(2): 2'-O-Methyl
  misc_feature (13)..(13): 2'-O-Methyl
uuaaggagaagcugacggctt

SEQ ID NO: 360 - DNA, 21 bp, Artificial Sequence
  Synthetic
  misc_feature (6)..(6): 2'-O-Methyl
  misc_feature (17)..(17): 2'-O-Methyl
gccgucagcuucuccuuaatt

SEQ ID NO: 361 - DNA, 21 bp, Artificial Sequence
  Synthetic
  misc_feature (2)..(2): 2'-O-Methyl
uuaaggagaagcugacggctt

SEQ ID NO: 362 - DNA, 21 bp, Artificial Sequence
  Synthetic
  misc_feature (17)..(17): 2'-O-Methyl
gccgucagcuucuccuuaatt

SEQ ID NO: 363 - DNA, 21 bp, Artificial Sequence
  Synthetic
aaggaacggggacacuuactt

SEQ ID NO: 364 - DNA, 21 bp, Artificial Sequence
  Synthetic
guaaguguccccguuccuutt

SEQ ID NO: 365 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaggaacggggacacuuactt

SEQ ID NO: 366 - DNA, 21 bp, Artificial Sequence
  Synthetic
  misc_feature (13)..(13): 2'-O-Methyl
  misc_feature (17)..(17): 2'-O-Methyl
aaggaacggggacacuuactt

SEQ ID NO: 367 - DNA, 21 bp, Artificial Sequence
  Synthetic
  misc_feature (2)..(2): 2'-O-Methyl
  misc_feature (6)..(6): 2'-O-Methyl
guaaguguccccguuccuutt

SEQ ID NO: 368 - DNA, 21 bp, Artificial Sequence
  Synthetic
  misc_feature (2)..(2): 2'-O-Methyl
guaaguguccccguuccuutt

SEQ ID NO: 369 - DNA, 21 bp, Artificial Sequence
  Synthetic
ggagcacgcuuacuaccuutt

SEQ ID NO: 370 - DNA, 21 bp, Artificial Sequence
  Synthetic
aagguaguaagcgugcucctt

SEQ ID NO: 371 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggagcacgcuuacuaccuutt

SEQ ID NO: 372 - DNA, 21 bp, Artificial Sequence
  Synthetic
  misc_feature (5)..(5): 2'-O-Methyl
  misc_feature (11)..(11): 2'-O-Methyl
  misc_feature (14)..(14): 2'-O-Methyl
ggagcacgcuuacuaccuutt

SEQ ID NO: 373 - DNA, 21 bp, Artificial Sequence
  Synthetic
  misc_feature (5)..(5): 2'-O-Methyl
  misc_feature (8)..(8): 2'-O-Methyl
  misc_feature (14)..(14): 2'-O-Methyl
aagguaguaagcgugcucctt

SEQ ID NO: 374 - DNA, 21 bp, Artificial Sequence
  Synthetic
  misc_feature (11)..(11): 2'-O-Methyl
  misc_feature (14)..(14): 2'-O-Methyl
ggagcacgcuuacuaccuutt

SEQ ID NO: 375 - DNA, 21 bp, Artificial Sequence
  Synthetic
  misc_feature (5)..(5): 2'-O-Methyl
  misc_feature (8)..(8): 2'-O-Methyl
aagguaguaagcgugcucctt

SEQ ID NO: 376 - DNA, 21 bp, Artificial Sequence
  Synthetic
ggcgggcucuuuccuauuctt

SEQ ID NO: 377 - DNA, 21 bp, Artificial Sequence
  Synthetic
gaauaggaaagagcccgcctt

SEQ ID NO: 378 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggcgggcucuuuccuauuctt

SEQ ID NO: 379 - DNA, 21 bp, Artificial Sequence
  Synthetic
  misc_feature (6)..(6): 2'-O-Methyl
  misc_feature (8)..(8): 2'-O-Methyl
  misc_feature (15)..(15): 2'-O-Methyl
ggcgggcucuuuccuauuctt

SEQ ID NO: 380 - DNA, 21 bp, Artificial Sequence
  Synthetic
  misc_feature (4)..(4): 2'-O-Methyl
gaauaggaaagagcccgcctt

SEQ ID NO: 381 - DNA, 21 bp, Artificial Sequence
  Synthetic
  misc_feature (15)..(15): 2'-O-Methyl
ggcgggcucuuuccuauuctt

SEQ ID NO: 382 - DNA, 21 bp, Artificial Sequence
  Synthetic
  misc_feature (4)..(4): 2'-O-Methyl
gaauaggaaagagcccgcctt

SEQ ID NO: 383 - DNA, 3233 bp, Macaca mulatta
  misc_feature (2570)..(2654): n is a, c, g, or t
aaaacttctgggagcctccaaactcctagctgtcttgtccctcgccctggagagaaggcagaaccatggcattttattgctgcttctgggtcctcttggcactcacctggcacacctctgcctatgggcccgaccagcgagcccaaaagaaaggggacattatacttggcgggctctttcctattcattttggagtagcagctaaagatcaagatctcaaatcaaggccggagtctgtggaatgcatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttacgcctcctccagcagactccttagcaacaagaatcaattcaagtccttcctccgaaccatccccaatgatgagcaccaggccactgccatggcagacatcattgagtatttccgctggaactgggtgggcacaattgcagctgatgatgactatgggcggccagggattgagaagttccgagaggaagctgaggaaagggacatctgcattgacttcagtgaactcatctcccagtactctgatgaggaagagatccagcatgtggtggaggtgattcaaaattccacggccaaagtaatcgtggttttctccagtggcccagaccttgagcccctcatcaaggagattgtccggcgcaatatcacaggcaagatctggctggccagtgaggcctgggccagctcctccctgatcgccatgcccgagtacttccacgtggttggaggcaccattggatttgctctgaaggctgggcagatcccaggctttcgggaattcctgaagaaggtccatcccaggaagtctgtccacaatggttttgccaaggagttttgggaagaaacatttaactgccacctccaagaaggtgccaaaggacctttacctgtggacacctttctgagaggtcacgaagaaagtggaggcaggtttagcaacagttcgacagccttccgacccctctgtacaggggatgagaacatcagcagtgttgagaccccttacatagattacacacatttacggatatcctacaatgtgtacttagcagtctactccattgcccatgccttgcaagatatatatacctgcttacctgggagagggctcttcaccaacggctcctgtgcagacatcaagaaagttgaggcgtggcaggtcctgaagcacctacggcacctaaactttaccaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgtctggcagggaccaggaaagggatcattgagggggagcccacctgctgctttgagtgtgtggagtgtcctgatggggagtacagcgatgagacagatgccagtgcctgtaacaagtgcccagatgacttctggtccaatgagaaccacacctcctgcattgccaaggagatcgagtttctgtcgtggacagagccctttgggattgcactcaccctctttgccgtgctgggcattttcctgacagcctttgtgctgggtgtgtttatcaagttccgcaacacgcccatcgtcaaggccacgaaccgagagctctcctaccttctcctcttctccctgctctgctgcttctccagctccctgttcttcattggggagccccaggactggacttgccgcctgcgccaaccggcctttggcatcagcttcgtgctctgcatctcgtgcatcctggtgaaaaccaaccgtgtcctcctggtgtttgaggccaagatccccaccagcttccaccgcaagtggtgggggctcaacctgcagtttctgctggttttcctctgcaccttcatgcagattgtcatctgtgtgatctggctctacaccgcgcccccctcaagctaccgcaaccacgagctggaggatgagatcatcttcatcacgtgccacgagggctcactcatggccctgggcttcctgatcggctacacctgcctgctggctgccatctgcttcttctttgccttcaagtcccggaagctgccagagaacttcaatgaagccaagttcatcaccttcagcatgctcatcttcttcattgtctggatctccttcattccagcctatgccagcacctacggcaagtttgtctctgcnnnnnnnnnnnnnnnnnnnnnnnnnnnnnnnnnnnnnnnnnnnnnnnnnnnnnnnnnnnnnnnnnnnnnnnnnnnnnnnnnnnnnccatcccgcaacaccatcgaggaggtgcgttgcagcaccgcagctcacgctttcaaggtggctgcccgggccacgctgcgccgcagcaacgtctcccgcaagcggtccagcagccttgggggctccactggatccaccccctcctcctccatcagcagcaagagcaacagcgaagacccattcccacagcccgagaggcagaagcagcagcagccgctgccaagatgcaagcagaaggtcatcttcggcagtggcacggtcaccttctcactgagcttcgatgagcctcagaagaacgccatggcccacaggaattctacacaccagaactccctggaggcccagaaaagcagcgatacgctggcccgacaccaggcattactcccgctgcagtgcggggaagcggactcagatctgagcgtccaagaaacaggtctgcaaggaccagtgggtggagaccaccggccagaggtggaggtccctgaagagttgtccccagcacttgtagtgtccagttcacagagctttgtcatcagcggtggaggaagcactgttacagaaaatgtactgcattcataa

SEQ ID NO: 384 - DNA, 21 bp, Artificial Sequence
  Synthetic
ccgagagcucuccuaccuutt

SEQ ID NO: 385 - DNA, 21 bp, Artificial Sequence
  Synthetic
aagguaggagagcucucggtt

SEQ ID NO: 386 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ccgagagcucuccuaccuutt

SEQ ID NO: 387 - DNA, 21 bp, Artificial Sequence
  Synthetic
  misc_feature (8)..(8): 2'-O-Methyl
  misc_feature (11)..(11): 2'-O-Methyl
  misc_feature (12)..(12): 2'-O-Methyl
ccgagagcucuccuaccuutt

SEQ ID NO: 388 - DNA, 21 bp, Artificial Sequence
  Synthetic
  misc_feature (5)..(5): 2'-O-Methyl
aagguaggagagcucucggtt

SEQ ID NO: 389 - DNA, 21 bp, Artificial Sequence
  Synthetic
  misc_feature (14)..(14): 2'-O-Methyl
ccgagagcucuccuaccuutt

SEQ ID NO: 390 - DNA, 21 bp, Artificial Sequence
  Synthetic
  misc_feature (5)..(5): 2'-O-Methyl
aagguaggagagcucucggtt

SEQ ID NO: 391 - DNA, 21 bp, Artificial Sequence
  Synthetic
cucuccuaccuucuccucutt

SEQ ID NO: 392 - DNA, 21 bp, Artificial Sequence
  Synthetic
agaggagaagguaggagagtt

SEQ ID NO: 393 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cucuccuaccuucuccucutt

SEQ ID NO: 394 - DNA, 21 bp, Artificial Sequence
  Synthetic
  misc_feature (7)..(7): 2'-Fluoro
  misc_feature (12)..(12): 2'-Fluoro
  misc_feature (17)..(17): 2'-Fluoro
cucuccuaccuucuccucutt

SEQ ID NO: 395 - DNA, 21 bp, Artificial Sequence
  Synthetic
  misc_feature (12)..(12): 2'-Fluoro
agaggagaagguaggagagtt

SEQ ID NO: 396 - DNA, 21 bp, Artificial Sequence
  Synthetic
  misc_feature (8)..(8): 2'-Fluoro
cucuccuaccuucuccucutt

SEQ ID NO: 397 - DNA, 21 bp, Artificial Sequence
  Synthetic
cuaccuucuccucuucucctt

SEQ ID NO: 398 - DNA, 21 bp, Artificial Sequence
  Synthetic
ggagaagaggagaagguagtt

SEQ ID NO: 399 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cuaccuucuccucuucucctt

SEQ ID NO: 400 - DNA, 21 bp, Artificial Sequence
  Synthetic
  misc_feature (2)..(3): 2'-O-Methyl
cuaccuucuccucuucucctt

SEQ ID NO: 401 - DNA, 21 bp, Artificial Sequence
  Synthetic
  misc_feature (17)..(18): 2'-O-Methyl
ggagaagaggagaagguagtt

SEQ ID NO: 402 - DNA, 21 bp, Artificial Sequence
  Synthetic
  misc_feature (2)..(2): 2'-O-Methyl
cuaccuucuccucuucucctt

SEQ ID NO: 403 - DNA, 21 bp, Artificial Sequence
  Synthetic
  misc_feature (17)..(17): 2'-O-Methyl
ggagaagaggagaagguagtt

SEQ ID NO: 404 - DNA, 21 bp, Artificial Sequence
  Synthetic
agccuccaaacuccuagcutt

SEQ ID NO: 405 - DNA, 21 bp, Artificial Sequence
  Synthetic
agcuaggaguuuggaggcutt

SEQ ID NO: 406 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
agccuccaaacuccuagcutt

SEQ ID NO: 407 - DNA, 21 bp, Artificial Sequence
  Synthetic
  misc_feature (7)..(7): 2'-Fluoro
  misc_feature (15)..(15): 2'-Fluoro
agccuccaaacuccuagcutt

SEQ ID NO: 408 - DNA, 21 bp, Artificial Sequence
  Synthetic
  misc_feature (4)..(4): 2'-Fluoro
  misc_feature (12)..(12): 2'-Fluoro
agcuaggaguuuggaggcutt

SEQ ID NO: 409 - DNA, 21 bp, Artificial Sequence
  Synthetic
  misc_feature (15)..(15): 2'-Fluoro
agccuccaaacuccuagcutt

SEQ ID NO: 410 - DNA, 21 bp, Artificial Sequence
  Synthetic
  misc_feature (4)..(4): 2'-Fluoro
agcuaggaguuuggaggcutt

SEQ ID NO: 411 - DNA, 21 bp, Artificial Sequence
  Synthetic
uccuagcugucuugucccutt

SEQ ID NO: 412 - DNA, 21 bp, Artificial Sequence
  Synthetic
agggacaagacagcuaggatt

SEQ ID NO: 413 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uccuagcugucuugucccutt

SEQ ID NO: 414 - DNA, 21 bp, Artificial Sequence
  Synthetic
  misc_feature (4)..(4): 2'-O-Methyl
  misc_feature (8)..(8): 2'-O-Methyl
  misc_feature (13)..(13): 2'-O-Methyl
uccuagcugucuugucccutt

SEQ ID NO: 415 - DNA, 21 bp, Artificial Sequence
  Synthetic
  misc_feature (6)..(6): 2'-O-Methyl
  misc_feature (11)..(11): 2'-O-Methyl
  misc_feature (15)..(15): 2'-O-Methyl
agggacaagacagcuaggatt

SEQ ID NO: 416 - DNA, 21 bp, Artificial Sequence
  Synthetic
  misc_feature (4)..(4): 2'-O-Methyl
uccuagcugucuugucccutt

SEQ ID NO: 417 - DNA, 21 bp, Artificial Sequence
  Synthetic
  misc_feature (15)..(15): 2'-O-Methyl
agggacaagacagcuaggatt

SEQ ID NO: 418 - DNA, 21 bp, Artificial Sequence
  Synthetic
auacuuggcgggcucuuuctt

SEQ ID NO: 419 - DNA, 21 bp, Artificial Sequence
  Synthetic
gaaagagcccgccaaguautt

SEQ ID NO: 420 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
auacuuggcgggcucuuuctt

SEQ ID NO: 421 - DNA, 21 bp, Artificial Sequence
  Synthetic
  misc_feature (2)..(2): 2'-O-Methyl
  misc_feature (6)..(6): 2'-O-Methyl
  misc_feature (10)..(10): 2'-O-Methyl
auacuuggcgggcucuuuctt

SEQ ID NO: 422 - DNA, 21 bp, Artificial Sequence
  Synthetic
  misc_feature (13)..(13): 2'-O-Methyl
  misc_feature (17)..(17): 2'-O-Methyl
gaaagagcccgccaaguautt

SEQ ID NO: 423 - DNA, 21 bp, Artificial Sequence
  Synthetic
  misc_feature (2)..(2): 2'-O-Methyl
auacuuggcgggcucuuuctt

SEQ ID NO: 424 - DNA, 21 bp, Artificial Sequence
  Synthetic
ggggcucuucuacauuccctt

SEQ ID NO: 425 - DNA, 21 bp, Artificial Sequence
  Synthetic
gggaauguagaagagcccctt

SEQ ID NO: 426 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggggcucuucuacauuccctt

SEQ ID NO: 427 - DNA, 21 bp, Artificial Sequence
  Synthetic
  misc_feature (11)..(11): 2'-O-Methyl
  misc_feature (15)..(15): 2'-O-Methyl
ggggcucuucuacauuccctt

SEQ ID NO: 428 - DNA, 21 bp, Artificial Sequence
  Synthetic
  misc_feature (6)..(6): 2'-O-Methyl
  misc_feature (8)..(8): 2'-O-Methyl
gggaauguagaagagcccctt

SEQ ID NO: 429 - DNA, 21 bp, Artificial Sequence
  Synthetic
  misc_feature (12)..(12): 2'-O-Methyl
ggggcucuucuacauuccctt

SEQ ID NO: 430 - DNA, 21 bp, Artificial Sequence
  Synthetic
  misc_feature (8)..(8): 2'-O-Methyl
gggaauguagaagagcccctt

SEQ ID NO: 431 - DNA, 21 bp, Artificial Sequence
  Synthetic
gaguauuuccgcuggaacutt

SEQ ID NO: 432 - DNA, 21 bp, Artificial Sequence
  Synthetic
aguuccagcggaaauacuctt

SEQ ID NO: 433 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
gaguauuuccgcuggaacutt

SEQ ID NO: 434 - DNA, 21 bp, Artificial Sequence
  Synthetic
  misc_feature (4)..(4): 2'-Fluoro
  misc_feature (13)..(13): 2'-Fluoro
gaguauuuccgcuggaacutt

SEQ ID NO: 435 - DNA, 21 bp, Artificial Sequence
  Synthetic
  misc_feature (6)..(6): 2'-Fluoro
  misc_feature (15)..(15): 2'-Fluoro
aguuccagcggaaauacuctt

SEQ ID NO: 436 - DNA, 21 bp, Artificial Sequence
  Synthetic
  misc_feature (4)..(4): 2'-Fluoro
gaguauuuccgcuggaacutt

SEQ ID NO: 437 - DNA, 21 bp, Artificial Sequence
  Synthetic
  misc_feature (15)..(15): 2'-Fluoro
aguuccagcggaaauacuctt

SEQ ID NO: 438 - DNA, 21 bp, Artificial Sequence
  Synthetic
gcugaggaaagggacaucutt

SEQ ID NO: 439 - DNA, 21 bp, Artificial Sequence
  Synthetic
agaugucccuuuccucagctt

SEQ ID NO: 440 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gcugaggaaagggacaucutt

SEQ ID NO: 441 - DNA, 21 bp, Artificial Sequence
  Synthetic
  misc_feature (3)..(3): 2'-O-Methyl
  misc_feature (13)..(13): 2'-O-Methyl
  misc_feature (15)..(15): 2'-O-Methyl
gcugaggaaagggacaucutt

SEQ ID NO: 442 - DNA, 21 bp, Artificial Sequence
  Synthetic
  misc_feature (4)..(4): 2'-O-Methyl
  misc_feature (16)..(16): 2'-O-Methyl
agaugucccuuuccucagctt

SEQ ID NO: 443 - DNA, 21 bp, Artificial Sequence
  Synthetic
  misc_feature (3)..(4): 2'-O-Methyl
agaugucccuuuccucagctt

SEQ ID NO: 444 - DNA, 21 bp, Artificial Sequence
  Synthetic
guacucugaugaggaagagtt

SEQ ID NO: 445 - DNA, 21 bp, Artificial Sequence
  Synthetic
cucuuccucaucagaguactt

SEQ ID NO: 446 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
guacucugaugaggaagagtt

SEQ ID NO: 447 - DNA, 21 bp, Artificial Sequence
  Synthetic
  misc_feature (2)..(2): 2'-O-Methyl
  misc_feature (7)..(7): 2'-O-Methyl
  misc_feature (10)..(10): 2'-O-Methyl
guacucugaugaggaagagtt

SEQ ID NO: 448 - DNA, 21 bp, Artificial Sequence
  Synthetic
  misc_feature (9)..(9): 2'-O-Methyl
  misc_feature (12)..(12): 2'-O-Methyl
  misc_feature (17)..(17): 2'-O-Methyl
cucuuccucaucagaguactt

SEQ ID NO: 449 - DNA, 21 bp, Artificial Sequence
  Synthetic
  misc_feature (2)..(2): 2'-O-Methyl
guacucugaugaggaagagtt

SEQ ID NO: 450 - DNA, 21 bp, Artificial Sequence
  Synthetic
ggccaaaguaaucgugguutt

SEQ ID NO: 451 - DNA, 21 bp, Artificial Sequence
  Synthetic
aaccacgauuacuuuggcctt

SEQ ID NO: 452 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggccaaaguaaucgugguutt

SEQ ID NO: 453 - DNA, 21 bp, Artificial Sequence
  Synthetic
  misc_feature (4)..(4): 2'-O-Methyl
  misc_feature (9)..(9): 2'-O-Methyl
  misc_feature (15)..(15): 2'-O-Methyl
ggccaaaguaaucgugguutt

SEQ ID NO: 454 - DNA, 21 bp, Artificial Sequence
  Synthetic
  misc_feature (4)..(4): 2'-O-Methyl
  misc_feature (10)..(10): 2'-O-Methyl
  misc_feature (15)..(15): 2'-O-Methyl
aaccacgauuacuuuggcctt

SEQ ID NO: 455 - DNA, 21 bp, Artificial Sequence
  Synthetic
  misc_feature (9)..(9): 2'-O-Methyl
ggccaaaguaaucgugguutt

SEQ ID NO: 456 - DNA, 21 bp, Artificial Sequence
  Synthetic
  misc_feature (10)..(10): 2'-O-Methyl
aaccacgauuacuuuggcctt

SEQ ID NO: 457 - DNA, 21 bp, Artificial Sequence
  Synthetic
gucuaugccaagaagggagtt

SEQ ID NO: 458 - DNA, 21 bp, Artificial Sequence
  Synthetic
cucccuucuuggcauagactt

SEQ ID NO: 459 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gucuaugccaagaagggagtt

SEQ ID NO: 460 - DNA, 21 bp, Artificial Sequence
  Synthetic
  misc_feature (4)..(4): 2'-O-Methyl
  misc_feature (6)..(6): 2'-O-Methyl
  misc_feature (9)..(9): 2'-O-Methyl
gucuaugccaagaagggagtt

SEQ ID NO: 461 - DNA, 21 bp, Artificial Sequence
  Synthetic
  misc_feature (10)..(10): 2'-O-Methyl
  misc_feature (13)..(13): 2'-O-Methyl
  misc_feature (15)..(15): 2'-O-Methyl
cucccuucuuggcauagactt

SEQ ID NO: 462 - DNA, 21 bp, Artificial Sequence
  Synthetic
  misc_feature (4)..(4): 2'-O-Methyl
gucuaugccaagaagggagtt

SEQ ID NO: 463 - DNA, 21 bp, Artificial Sequence
  Synthetic
  misc_feature (15)..(15): 2'-O-Methyl
cucccuucuuggcauagactt

SEQ ID NO: 464 - DNA, 21 bp, Artificial Sequence
  Synthetic
ucuacaccgcgccccccuctt

SEQ ID NO: 465 - DNA, 21 bp, Artificial Sequence
  Synthetic
gaggggggcgcgguguagatt

SEQ ID NO: 466 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ucuacaccgcgccccccuctt

SEQ ID NO: 467 - DNA, 21 bp, Artificial Sequence
  Synthetic
  misc_feature (3)..(3): 2'-O-Methyl
  misc_feature (5)..(5): 2'-O-Methyl
  misc_feature (10)..(10): 2'-O-Methyl
  misc_feature (13)..(13): 2'-O-Methyl
ucuacaccgcgccccccuctt

SEQ ID NO: 468 - DNA, 21 bp, Artificial Sequence
  Synthetic
  misc_feature (14)..(14): 2'-O-Methyl
  misc_feature (16)..(16): 2'-O-Methyl
gaggggggcgcgguguagatt

SEQ ID NO: 469 - DNA, 21 bp, Artificial Sequence
  Synthetic
  misc_feature (3)..(3): 2'-O-Methyl
ucuacaccgcgccccccuctt

SEQ ID NO: 470 - DNA, 21 bp, Artificial Sequence
  Synthetic
  misc_feature (16)..(16): 2'-O-Methyl
gaggggggcgcgguguagatt

SEQ ID NO: 471 - DNA, 21 bp, Artificial Sequence
  Synthetic
cgccccccucaagcuaccgtt

SEQ ID NO: 472 - DNA, 21 bp, Artificial Sequence
  Synthetic
cgguagcuugaggggggcgtt

SEQ ID NO: 473 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cgccccccucaagcuaccgtt

SEQ ID NO: 474 - DNA, 21 bp, Artificial Sequence
  Synthetic
  misc_feature (3)..(3): 2'-O-Methyl
  misc_feature (6)..(6): 2'-O-Methyl
  misc_feature (10)..(10): 2'-O-Methyl
  misc_feature (15)..(15): 2'-O-Methyl
cgccccccucaagcuaccgtt

SEQ ID NO: 475 - DNA, 21 bp, Artificial Sequence
  Synthetic
  misc_feature (4)..(4): 2'-O-Methyl
  misc_feature (9)..(9): 2'-O-Methyl
cgguagcuugaggggggcgtt

SEQ ID NO: 476 - DNA, 21 bp, Artificial Sequence
  Synthetic
  misc_feature (15)..(15): 2'-O-Methyl
cgccccccucaagcuaccgtt

SEQ ID NO: 477 - DNA, 21 bp, Artificial Sequence
  Synthetic
  misc_feature (4)..(4): 2'-O-Methyl
cgguagcuugaggggggcgtt

SEQ ID NO: 478 - DNA, 21 bp, Artificial Sequence
  Synthetic
gcuaccgcaaccacgagcutt

SEQ ID NO: 479 - DNA, 21 bp, Artificial Sequence
  Synthetic
agcucgugguugcgguagctt

SEQ ID NO: 480 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
gcuaccgcaaccacgagcutt

SEQ ID NO: 481 - DNA, 21 bp, Artificial Sequence
  Synthetic
  misc_feature (3)..(3): 2'-Fluoro
  misc_feature (8)..(8): 2'-Fluoro
  misc_feature (12)..(12): 2'-Fluoro
gcuaccgcaaccacgagcutt

SEQ ID NO: 482 - DNA, 21 bp, Artificial Sequence
  Synthetic
  misc_feature (7)..(7): 2'-Fluoro
  misc_feature (11)..(11): 2'-Fluoro
  misc_feature (16)..(16): 2'-Fluoro
agcucgugguugcgguagctt

SEQ ID NO: 483 - DNA, 21 bp, Artificial Sequence
  Synthetic
  misc_feature (3)..(3): 2'-Fluoro
gcuaccgcaaccacgagcutt

SEQ ID NO: 484 - DNA, 21 bp, Artificial Sequence
  Synthetic
  misc_feature (16)..(16): 2'-Fluoro
agcucgugguugcgguagctt

SEQ ID NO: 485 - DNA, 21 bp, Artificial Sequence
  Synthetic
cuccuucauuccagccuautt

SEQ ID NO: 486 - DNA, 21 bp, Artificial Sequence
  Synthetic
auaggcuggaaugaaggagtt

SEQ ID NO: 487 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cuccuucauuccagccuautt

SEQ ID NO: 488 - DNA, 21 bp, Artificial Sequence
  Synthetic
  misc_feature (7)..(7): 2'-O-Methyl
  misc_feature (12)..(12): 2'-O-Methyl
  misc_feature (17)..(17): 2'-O-Methyl
cuccuucauuccagccuautt

SEQ ID NO: 489 - DNA, 21 bp, Artificial Sequence
  Synthetic
  misc_feature (2)..(2): 2'-O-Methyl
  misc_feature (7)..(7): 2'-O-Methyl
  misc_feature (12)..(12): 2'-O-Methyl
auaggcuggaaugaaggagtt

SEQ ID NO: 490 - DNA, 21 bp, Artificial Sequence
  Synthetic
  misc_feature (17)..(17): 2'-O-Methyl
cuccuucauuccagccuautt

SEQ ID NO: 491 - DNA, 21 bp, Artificial Sequence
  Synthetic
  misc_feature (2)..(2): 2'-O-Methyl
auaggcuggaaugaaggagtt

SEQ ID NO: 492 - DNA, 21 bp, Artificial Sequence
  Synthetic
agaaaagcagcgauacgcutt

SEQ ID NO: 493 - DNA, 21 bp, Artificial Sequence
  Synthetic
agcguaucgcugcuuuucutt

SEQ ID NO: 494 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agaaaagcagcgauacgcutt

SEQ ID NO: 495 - DNA, 21 bp, Artificial Sequence
  Synthetic
  misc_feature (8)..(8): 2'-O-Methyl
  misc_feature (14)..(14): 2'-O-Methyl
agaaaagcagcgauacgcutt

SEQ ID NO: 496 - DNA, 21 bp, Artificial Sequence
  Synthetic
  misc_feature (11)..(11): 2'-O-Methyl
agcguaucgcugcuuuucutt

SEQ ID NO: 497 - DNA, 21 bp, Artificial Sequence
  Synthetic
  misc_feature (14)..(14): 2'-O-Methyl
agaaaagcagcgauacgcutt

SEQ ID NO: 498 - DNA, 2694 bp, Canis lupus
ggggggggggggccggactcaactctactgtggagtcggggccatccctcatttttctcactcaggagcggctggctggcggcggctggctggcggcaggagctggcaatgtttggcctcaagagaaacgcagtaatccggactcaactctactgtgggggggccgggctgggggccggcagcggcggcgcctcctcttcgggagggcggcttttggcttcggggagggaggccacgaccagacgggagggagggggaggggaagccggtgcggtgattggcggaagcgccggcgcaagtcccccgaccactctggcgccggacgcccggagggtcgcgcggccctcacccattggcgctgagggccccaacgtcagcgcgacccccccgaggctgctgctgctcgcgcccccctgccgcgcgtcgccgcctgaagagatggaaggcccggccgccgacgccatcatgtcgcccgaagaggagctagacgggtacgagccggaacctttggggaagcggccggcggtcctgcctctgctggagctggtgggggaggccagcagtggccccggcatggacggctcgctaccctcgacgccacccccggcggaggaggaggaagatgagttgtaccggcagtccctggagattatctctcggtaccttcgggaacaggccacaggcgccaaggacgcgaaaccactgggcgggtctcgggcggccagccggaaggcgttagagaccctccagcgagtcggggacggggtacagcgcaaccacgagacagccttccaaggcatgcttcggaaactggacatcaaaaacgaagacgatgtcaaatcgttgtctcgagtgattgtccatgttttcagtgacggagtaacaaactggggcaggattgtgactcttatttcctttggtgcctttgtggccaaacacttgaagagtataaaccaagaaagctgcatcgaaccattagcagaaagcatcacagatgttctcgtaaggacgaaacgagactggctagtcaaacaaagaggctgggatgggtttgtggagttcttccatgtagaggacctagaaggcggcatcagaaatgtgctgctggcttttgcaggtgttgctggagtaggagctggtttggcatatctaataagatagccttttaagtgcaataattaacttttaaacaaccccaggcaccaaaaccacatatgactgctgtgaaatcaaatgtatttatgaagttggactttgagctgtccaggctgtaacctcggagagttctactctagcaacgtagaaaagcaagtggcaagaggattatggctaacaggaataaatacatgggagaagtagtcccccttgaagagtcactgtctaaaagaagcagagctcagtttcagcaacaggcaaacttggggaggccatggaggaggacttttagatttagtaaagttggtagggttgaagagacttaattttcttgtctagaacaggagagtggccagtagccaggctagtcatagagtccattaaatatgtccactgaattcattaacttcccatatagtgttaaaagagaagcactaacaatggcattgatctgtatgaaatggatttaagctacaggtgatagaactatgactagaagccgcagtactgtacaacagtgtgaaggaaagctttttctctgtaattagctttcccaagtatacttcttgaaagtccaagtgctcaggacgttttacctgttctactttggcttggtttgagtggtttagtttattagcctagtaatggccaacaatacttgacttagggtcaataattacaattgcaaatgtgggaatagcctcaatttttaaggcaaaaacaaattataaatgtatttgtctgtaaaaattgtgtatatttttacagaaagtctatttctttgaaatgtaaagggatgaagagtctcaaaatatattagtttttttttcatgcccgtttgaaatttacaacttctgtagttaggaatctatttcttacagcttttctaaattttgtcctggtcagttctagattgtatacagaaccaattgatgtaattgtatgcaacttggttgtagtggaacaattccaattcataactatgcagactttttaattttcctatctgattggtaagtattctttagtggttttgggtgttttgttttgttttaaacctgggattgagaagttgatgaatggaaattcatcctttaacttcattacatgtgggtttacaataattgagtcaaggtgaagtttgaagtttgggggcagggggcgtgtgtgggttgataacttaaaaaaataatgggctctgattgggcagctactcatttgagttccttccatttgacctaatttaactggtgaaatttaaattgagtttatgagctcatcttcaaaacttttgctagaagattttcagctgttccaaatgggacttactaacagtatgtatataaaaagatcacatcagtggatgagagacatttgatcccttgtttgcttaataaattgtaaaatgatggcttggaaaagcaggcttatagtctaaccatggtgctattattaggcttgcttgttaaacacaggtctaagcctagtatatcaataaaacaaatacttatttcatttgaaaaaaaaaaaaaaaaaaaa

SEQ ID NO: 499 - DNA, 21 bp, Artificial Sequence
  Synthetic
ggagcuagacggguacgagtt

SEQ ID NO: 500 - DNA, 21 bp, Artificial Sequence
  Synthetic
cucguacccgucuagcucctt

SEQ ID NO: 501 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
ggagcuagacggguacgagtt

SEQ ID NO: 502 - DNA, 21 bp, Artificial Sequence
  Synthetic
  misc_feature (6)..(6): 2'-O-Methyl
  misc_feature (14)..(14): 2'-O-Methyl
ggagcuagacggguacgagtt

SEQ ID NO: 503 - DNA, 21 bp, Artificial Sequence
  Synthetic
  misc_feature (5)..(5): 2'-O-Methyl
  misc_feature (13)..(13): 2'-O-Methyl
cucguacccgucuagcucctt

SEQ ID NO: 504 - DNA, 21 bp, Artificial Sequence
  Synthetic
  misc_feature (6)..(7): 2'-O-Methyl
  misc_feature (14)..(14): 2'-O-Methyl
ggagcuagacggguacgagtt

SEQ ID NO: 505 - DNA, 21 bp, Artificial Sequence
  Synthetic
  misc_feature (13)..(13): 2'-O-Methyl
cucguacccgucuagcucctt

SEQ ID NO: 506 - DNA, 21 bp, Artificial Sequence
  Synthetic
cggguacgagccggaaccutt

SEQ ID NO: 507 - DNA, 21 bp, Artificial Sequence
  Synthetic
agguuccggcucguacccgtt

SEQ ID NO: 508 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cggguacgagccggaaccutt

SEQ ID NO: 509 - DNA, 21 bp, Artificial Sequence
  Synthetic
  misc_feature (5)..(6): 2'-Fluoro
cggguacgagccggaaccutt

SEQ ID NO: 510 - DNA, 21 bp, Artificial Sequence
  Synthetic
  misc_feature (14)..(14): 2'-Fluoro
agguuccggcucguacccgtt

SEQ ID NO: 511 - DNA, 21 bp, Artificial Sequence
  Synthetic
  misc_feature (14)..(14): 2'-Fluoro
agguuccggcucguacccgtt

SEQ ID NO: 512 - DNA, 21 bp, Artificial Sequence
  Synthetic
acggcucgcuacccucgactt

SEQ ID NO: 513 - DNA, 21 bp, Artificial Sequence
  Synthetic
gucgaggguagcgagccgutt

SEQ ID NO: 514 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
acggcucgcuacccucgactt

SEQ ID NO: 515 - DNA, 21 bp, Artificial Sequence
  Synthetic
  misc_feature (10)..(10): 2'-Fluoro
acggcucgcuacccucgactt

SEQ ID NO: 516 - DNA, 21 bp, Artificial Sequence
  Synthetic
  misc_feature (9)..(9): 2'-Fluoro
gucgaggguagcgagccgutt

SEQ ID NO: 517 - DNA, 21 bp, Artificial Sequence
  Synthetic
  misc_feature (11)..(11): 2'-Fluoro
acggcucgcuacccucgactt

SEQ ID NO: 518 - DNA, 21 bp, Artificial Sequence
  Synthetic
agaggaccuagaaggcggctt

SEQ ID NO: 519 - DNA, 21 bp, Artificial Sequence
  Synthetic
gccgccuucuagguccucutt

SEQ ID NO: 520 - DNA, 21 bp, Artificial Sequence
  Synthetic
  misc_feature (9)..(9): 2'-O-Methyl
agaggaccuagaaggcggctt

SEQ ID NO: 521 - DNA, 21 bp, Artificial Sequence
  Synthetic
  misc_feature (7)..(8): 2'-O-Methyl
  misc_feature (10)..(10): 2'-O-Methyl
  misc_feature (14)..(14): 2'-O-Methyl
  misc_feature (17)..(17): 2'-O-Methyl
  misc_feature (19)..(19): 2'-O-Methyl
gccgccuucuagguccucutt

SEQ ID NO: 522 - DNA, 21 bp, Artificial Sequence
  Synthetic
  misc_feature (9)..(9): 2'-O-Methyl
agaggaccuagaaggcggctt

SEQ ID NO: 523 - DNA, 21 bp, Artificial Sequence
  Synthetic
  misc_feature (10)..(10): 2'-O-Methyl
gccgccuucuagguccucutt

SEQ ID NO: 524 - DNA, 21 bp, Artificial Sequence
  Synthetic
  misc_feature (10)..(10): 2'-O-Methyl
agaggaccuagaaggcggctt

SEQ ID NO: 525 - DNA, 21 bp, Artificial Sequence
  Synthetic
aacucuacuguggagucggtt

SEQ ID NO: 526 - DNA, 21 bp, Artificial Sequence
  Synthetic
ccgacuccacaguagaguutt

SEQ ID NO: 527 - DNA, 21 bp, Artificial Sequence
  Synthetic
  misc_feature (3)..(3): 2'-O-Methyl
  misc_feature (5)..(5): 2'-O-Methyl
  misc_feature (8)..(8): 2'-O-Methyl
  misc_feature (17)..(17): 2'-O-Methyl
aacucuacuguggagucggtt

SEQ ID NO: 528 - DNA, 21 bp, Artificial Sequence
  Synthetic
  misc_feature (1)..(2): 2'-O-Methyl
  misc_feature (5)..(5): 2'-O-Methyl
  misc_feature (7)..(8): 2'-O-Methyl
  misc_feature (10)..(10): 2'-O-Methyl
ccgacuccacaguagaguutt

SEQ ID NO: 529 - DNA, 21 bp, Artificial Sequence
  Synthetic
  misc_feature (6)..(6): 2'-O-Methyl
  misc_feature (9)..(9): 2'-O-Methyl
  misc_feature (11)..(11): 2'-O-Methyl
aacucuacuguggagucggtt

SEQ ID NO: 530 - DNA, 21 bp, Artificial Sequence
  Synthetic
  misc_feature (8)..(8): 2'-O-Methyl
  misc_feature (13)..(13): 2'-O-Methyl
ccgacuccacaguagaguutt

SEQ ID NO: 531 - DNA, 21 bp, Artificial Sequence
  Synthetic
  misc_feature (6)..(6): 2'-O-Methyl
aacucuacuguggagucggtt

SEQ ID NO: 532 - DNA, 21 bp, Artificial Sequence
  Synthetic
  misc_feature (13)..(13): 2'-O-Methyl
ccgacuccacaguagaguutt

SEQ ID NO: 533 - DNA, 21 bp, Artificial Sequence
  Synthetic
agaaacgcaguaauccggatt

SEQ ID NO: 534 - DNA, 21 bp, Artificial Sequence
  Synthetic
uccggauuacugcguuucutt

SEQ ID NO: 535 - DNA, 21 bp, Artificial Sequence
  Synthetic
  misc_feature (6)..(6): 2'-O-Methyl
  misc_feature (8)..(8): 2'-O-Methyl
  misc_feature (11)..(11): 2'-O-Methyl
  misc_feature (14)..(16): 2'-O-Methyl
agaaacgcaguaauccggatt

SEQ ID NO: 536 - DNA, 21 bp, Artificial Sequence
  Synthetic
  misc_feature (1)..(3): 2'-O-Methyl
  misc_feature (7)..(8): 2'-O-Methyl
  misc_feature (10)..(11): 2'-O-Methyl
  misc_feature (13)..(13): 2'-O-Methyl
  misc_feature (15)..(19): 2'-O-Methyl
uccggauuacugcguuucutt

SEQ ID NO: 537 - DNA, 21 bp, Artificial Sequence
  Synthetic
  misc_feature (8)..(8): 2'-O-Methyl
  misc_feature (11)..(11): 2'-O-Methyl
agaaacgcaguaauccggatt

SEQ ID NO: 538 - DNA, 21 bp, Artificial Sequence
  Synthetic
  misc_feature (8)..(8): 2'-O-Methyl
  misc_feature (11)..(11): 2'-O-Methyl
uccggauuacugcguuucutt

SEQ ID NO: 539 - DNA, 21 bp, Artificial Sequence
  Synthetic
  misc_feature (11)..(12): 2'-O-Methyl
agaaacgcaguaauccggatt

SEQ ID NO: 540 - DNA, 21 bp, Artificial Sequence
  Synthetic
  misc_feature (8)..(8): 2'-O-Methyl
uccggauuacugcguuucutt

SEQ ID NO: 541 - DNA, 21 bp, Artificial Sequence
  Synthetic
aguaauccggacucaacuctt

SEQ ID NO: 542 - DNA, 21 bp, Artificial Sequence
  Synthetic
gaguugaguccggauuacutt

SEQ ID NO: 543 - DNA, 21 bp, Artificial Sequence
  Synthetic
  misc_feature (3)..(3): 2'-Fluoro
  misc_feature (6)..(8): 2'-Fluoro
  misc_feature (12)..(14): 2'-Fluoro
  misc_feature (17)..(19): 2'-Fluoro
aguaauccggacucaacuctt

SEQ ID NO: 544 - DNA, 21 bp, Artificial Sequence
  Synthetic
  misc_feature (3)..(3): 2'-Fluoro
  misc_feature (14)..(14): 2'-Fluoro
aguaauccggacucaacuctt

SEQ ID NO: 545 - DNA, 21 bp, Artificial Sequence
  Synthetic
  misc_feature (5)..(5): 2'-Fluoro
  misc_feature (16)..(16): 2'-Fluoro
gaguugaguccggauuacutt

SEQ ID NO: 546 - DNA, 21 bp, Artificial Sequence
  Synthetic
  misc_feature (3)..(3): 2'-Fluoro
aguaauccggacucaacuctt

SEQ ID NO: 547 - DNA, 21 bp, Artificial Sequence
  Synthetic
  misc_feature (16)..(16): 2'-Fluoro
gaguugaguccggauuacutt

SEQ ID NO: 548 - DNA, 21 bp, Artificial Sequence
  Synthetic
gaggaagaugaguuguacctt

SEQ ID NO: 549 - DNA, 21 bp, Artificial Sequence
  Synthetic
gguacaacucaucuuccuctt

SEQ ID NO: 550 - DNA, 21 bp, Artificial Sequence
  Synthetic
  misc_feature (1)..(8): 2'-O-Methyl
  misc_feature (10)..(12): 2'-O-Methyl
  misc_feature (15)..(15): 2'-O-Methyl
  misc_feature (17)..(17): 2'-O-Methyl
gaggaagaugaguuguacctt

SEQ ID NO: 551 - DNA, 21 bp, Artificial Sequence
  Synthetic
  misc_feature (9)..(9): 2'-O-Methyl
  misc_feature (14)..(14): 2'-O-Methyl
  misc_feature (16)..(16): 2'-O-Methyl
gaggaagaugaguuguacctt

SEQ ID NO: 552 - DNA, 21 bp, Artificial Sequence
  Synthetic
  misc_feature (5)..(5): 2'-O-Methyl
  misc_feature (10)..(10): 2'-O-Methyl
gguacaacucaucuuccuctt

SEQ ID NO: 553 - DNA, 21 bp, Artificial Sequence
  Synthetic
  misc_feature (9)..(9): 2'-O-Methyl
gaggaagaugaguuguacctt

SEQ ID NO: 554 - DNA, 21 bp, Artificial Sequence
  Synthetic
  misc_feature (5)..(5): 2'-O-Methyl
  misc_feature (10)..(10): 2'-O-Methyl
gguacaacucaucuuccuctt

SEQ ID NO: 555 - DNA, 21 bp, Artificial Sequence
  Synthetic
agauguucucguaaggacgtt

SEQ ID NO: 556 - DNA, 21 bp, Artificial Sequence
  Synthetic
cguccuuacgagaacaucutt

SEQ ID NO: 557 - DNA, 21 bp, Artificial Sequence
  Synthetic
  misc_feature (2)..(2): 2'-O-Methyl
  misc_feature (4)..(4): 2'-O-Methyl
  misc_feature (6)..(10): 2'-O-Methyl
  misc_feature (12)..(12): 2'-O-Methyl
  misc_feature (15)..(15): 2'-O-Methyl
  misc_feature (18)..(18): 2'-O-Methyl
agauguucucguaaggacgtt

SEQ ID NO: 558 - DNA, 21 bp, Artificial Sequence
  Synthetic
  misc_feature (4)..(4): 2'-O-Methyl
  misc_feature (12)..(12): 2'-O-Methyl
agauguucucguaaggacgtt

SEQ ID NO: 559 - DNA, 21 bp, Artificial Sequence
  Synthetic
  misc_feature (7)..(7): 2'-O-Methyl
  misc_feature (15)..(15): 2'-O-Methyl
cguccuuacgagaacaucutt

SEQ ID NO: 560 - DNA, 21 bp, Artificial Sequence
  Synthetic
  misc_feature (7)..(7): 2'-O-Methyl
cguccuuacgagaacaucutt

SEQ ID NO: 561 - DNA, 21 bp, Artificial Sequence
  Synthetic
ucucguaaggacgaaacgatt

SEQ ID NO: 562 - DNA, 21 bp, Artificial Sequence
  Synthetic
ucguuucguccuuacgagatt

SEQ ID NO: 563 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
ucucguaaggacgaaacgatt

SEQ ID NO: 564 - DNA, 21 bp, Artificial Sequence
  Synthetic
  misc_feature (6)..(7): 2'-O-Methyl
  misc_feature (15)..(15): 2'-O-Methyl
  misc_feature (17)..(17): 2'-O-Methyl
ucucguaaggacgaaacgatt

SEQ ID NO: 565 - DNA, 21 bp, Artificial Sequence
  Synthetic
  misc_feature (13)..(13): 2'-O-Methyl
ucguuucguccuuacgagatt

SEQ ID NO: 566 - DNA, 21 bp, Artificial Sequence
  Synthetic
  misc_feature (13)..(13): 2'-O-Methyl
ucguuucguccuuacgagatt

SEQ ID NO: 567 - DNA, 21 bp, Artificial Sequence
  Synthetic
gcuguaaccucggagaguutt

SEQ ID NO: 568 - DNA, 21 bp, Artificial Sequence
  Synthetic
aacucuccgagguuacagctt

SEQ ID NO: 569 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
gcuguaaccucggagaguutt

SEQ ID NO: 570 - DNA, 21 bp, Artificial Sequence
  Synthetic
  misc_feature (3)..(3): 2'-Fluoro
  misc_feature (5)..(5): 2'-Fluoro
gcuguaaccucggagaguutt

SEQ ID NO: 571 - DNA, 21 bp, Artificial Sequence
  Synthetic
  misc_feature (14)..(14): 2'-Fluoro
  misc_feature (16)..(16): 2'-Fluoro
aacucuccgagguuacagctt

SEQ ID NO: 572 - DNA, 21 bp, Artificial Sequence
  Synthetic
  misc_feature (5)..(5): 2'-Fluoro
gcuguaaccucggagaguutt

SEQ ID NO: 573 - DNA, 21 bp, Artificial Sequence
  Synthetic
  misc_feature (14)..(14): 2'-Fluoro
aacucuccgagguuacagctt

SEQ ID NO: 574 - DNA, 21 bp, Artificial Sequence
  Synthetic
ccucggagaguucuacucutt

SEQ ID NO: 575 - DNA, 21 bp, Artificial Sequence
  Synthetic
agaguagaacucuccgaggtt

SEQ ID NO: 576 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
ccucggagaguucuacucutt

SEQ ID NO: 577 - DNA, 21 bp, Artificial Sequence
  Synthetic
  misc_feature (14)..(14): 2'-O-Methyl
ccucggagaguucuacucutt

SEQ ID NO: 578 - DNA, 21 bp, Artificial Sequence
  Synthetic
  misc_feature (5)..(5): 2'-O-Methyl
agaguagaacucuccgaggtt

SEQ ID NO: 579 - DNA, 21 bp, Artificial Sequence
  Synthetic
  misc_feature (5)..(5): 2'-O-Methyl
agaguagaacucuccgaggtt

SEQ ID NO: 580 - DNA, 21 bp, Artificial Sequence
  Synthetic
gcaaguggcaagaggauuatt

SEQ ID NO: 581 - DNA, 21 bp, Artificial Sequence
  Synthetic
uaauccucuugccacuugctt

SEQ ID NO: 582 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
gcaaguggcaagaggauuatt

SEQ ID NO: 583 - DNA, 21 bp, Artificial Sequence
  Synthetic
  misc_feature (2)..(2): 2'-O-Methyl
  misc_feature (18)..(18): 2'-O-Methyl
gcaaguggcaagaggauuatt

SEQ ID NO: 584 - DNA, 21 bp, Artificial Sequence
  Synthetic
  misc_feature (1)..(1): 2'-O-Methyl
  misc_feature (10)..(10): 2'-O-Methyl
  misc_feature (13)..(13): 2'-O-Methyl
  misc_feature (17)..(17): 2'-O-Methyl
uaauccucuugccacuugctt

SEQ ID NO: 585 - DNA, 21 bp, Artificial Sequence
  Synthetic
  misc_feature (18)..(18): 2'-O-Methyl
gcaaguggcaagaggauuatt

SEQ ID NO: 586 - DNA, 21 bp, Artificial Sequence
  Synthetic
  misc_feature (1)..(1): 2'-O-Methyl
uaauccucuugccacuugctt

SEQ ID NO: 587 - DNA, 21 bp, Artificial Sequence
  Synthetic
augggagaaguaguccccctt

SEQ ID NO: 588 - DNA, 21 bp, Artificial Sequence
  Synthetic
gggggacuacuucucccautt

SEQ ID NO: 589 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
augggagaaguaguccccctt

SEQ ID NO: 590 - DNA, 21 bp, Artificial Sequence
  Synthetic
  misc_feature (2)..(2): 2'-O-Methyl
  misc_feature (11)..(11): 2'-O-Methyl
augggagaaguaguccccctt

SEQ ID NO: 591 - DNA, 21 bp, Artificial Sequence
  Synthetic
  misc_feature (8)..(8): 2'-O-Methyl
  misc_feature (17)..(17): 2'-O-Methyl
gggggacuacuucucccautt

SEQ ID NO: 592 - DNA, 21 bp, Artificial Sequence
  Synthetic
  misc_feature (11)..(11): 2'-O-Methyl
augggagaaguaguccccctt

SEQ ID NO: 593 - DNA, 21 bp, Artificial Sequence
  Synthetic
  misc_feature (8)..(8): 2'-O-Methyl
gggggacuacuucucccautt

SEQ ID NO: 594 - DNA, 21 bp, Artificial Sequence
  Synthetic
aaguagucccccuugaagatt

SEQ ID NO: 595 - DNA, 21 bp, Artificial Sequence
  Synthetic
ucuucaagggggacuacuutt

SEQ ID NO: 596 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
aaguagucccccuugaagatt

SEQ ID NO: 597 - DNA, 21 bp, Artificial Sequence
  Synthetic
  misc_feature (4)..(4): 2'-Fluoro
  misc_feature (11)..(11): 2'-Fluoro
  misc_feature (14)..(14): 2'-Fluoro
aaguagucccccuugaagatt

SEQ ID NO: 598 - DNA, 21 bp, Artificial Sequence
  Synthetic
  misc_feature (5)..(5): 2'-Fluoro
  misc_feature (15)..(15): 2'-Fluoro
ucuucaagggggacuacuutt

SEQ ID NO: 599 - DNA, 21 bp, Artificial Sequence
  Synthetic
  misc_feature (5)..(5): 2'-Fluoro
aaguagucccccuugaagatt

SEQ ID NO: 600 - DNA, 21 bp, Artificial Sequence
  Synthetic
  misc_feature (15)..(15): 2'-Fluoro
ucuucaagggggacuacuutt

SEQ ID NO: 601 - DNA, 21 bp, Artificial Sequence
  Synthetic
gguaggguugaagagacuutt

SEQ ID NO: 602 - DNA, 21 bp, Artificial Sequence
  Synthetic
aagucucuucaacccuacctt

SEQ ID NO: 603 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
gguaggguugaagagacuutt

SEQ ID NO: 604 - DNA, 21 bp, Artificial Sequence
  Synthetic
  misc_feature (13)..(13): 2'-O-Methyl
  misc_feature (17)..(17): 2'-O-Methyl
aagucucuucaacccuacctt

SEQ ID NO: 605 - DNA, 21 bp, Artificial Sequence
  Synthetic
  misc_feature (3)..(3): 2'-O-Methyl
  misc_feature (9)..(9): 2'-O-Methyl
gguaggguugaagagacuutt

SEQ ID NO: 606 - DNA, 21 bp, Artificial Sequence
  Synthetic
  misc_feature (10)..(10): 2'-O-Methyl
  misc_feature (16)..(16): 2'-O-Methyl
aagucucuucaacccuacctt

SEQ ID NO: 607 - DNA, 21 bp, Artificial Sequence
  Synthetic
  misc_feature (16)..(16): 2'-O-Methyl
aagucucuucaacccuacctt

SEQ ID NO: 608 - DNA, 3863 bp, Rattus norvegicus
ctgcgccggaggagccggcgcttgccggtgcctgggggtcggggcgcggggaaacccgggccgctggggtgacccaacaggtagagccggggccacggccggccacgcgccccccgcgtgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaattgagcggcggaggcggcggccccggctcgggcccgggagctgcgaccagcgcctcggcagcagcggtgacggtggctgactcggcggtggcgaccatggagaaccatcagcacggagctcaagtgctcctgcgggaggaagtggtccagcttcaggaggaagtccaccttctccgacagatgaaggaaatgctggcaaaggacctagaggagtcacagggcggcaaatgctccgaggtgctgtcggccactgaactccgggtgcagctggtacagaaggagcaggagctggccagagccagggaagccttgcaagccatgaaagctgaccggaagcgcttaaagggcgagaagaccgacctggtgagccagatgcagcagttgtacgccacgctggagagccgcgaggagcagttgcgagacttcatccgcaactatgaacaacaccgcaaggagagtgaggatgctgtcaaagcgctggccaaggagaaagacctgctggagcgagagaagtgggagctccgacggcaggccaaggaggccacggaccatgctgcggccctgcgctcccagctggacctcaaggacaaccgcatgaaggagctggaggccgagctagccatggccaagcagtccttagccacactgaccaaggatgttcccaagaggcattcactcgccatgcccggcgagacggtgctcaatggcaaccaggaatgggtggtgcaggctgacctcccactgactgccgccatccggcagagccaacagactctctaccactcccaccctccccaccctgcagaccgacaagcggtcagggtgagcccctgccactcaagacagccttccgtcatctctgatgcttccgctgctgaaggtgaccggtcatctacaccgagcgacatcaactccccaagacaccggacacactccctctgcaacggcgacagtcccggcccagttcagaagagcctacacaaccctattgtacagtcactagaggatcttgaagaccaaaaacggaaaaagaagaaagagaagatgggatttggctccatctctcgagtcttcgccagagggaaacaacggaagtccctcgacccgggcctctttgatggtaccgcccctgattattacatagaggaagacgcggactggtgataacccaccgccctccgcccgttgtccacgggcgtgtctgtgtgtggatgagccttggagagtgtgcgagagtgtgcgtgcgcgtggggatgcggagcctgtgtgtggggtgtgtgtgcacggaggcactcgccctcgtgggtgcgtgtagccaagcgcctggaacagacagaaacacaaatgtgacccccaacccccctccgcgtcgtcacctctgtaatcgctgtacataccacaaaccgtgtgtgactctgtcaaccccgttgtctctgagcgatacacttgtgtttgtttctctcgtttgttttgtttttcgatgttttttgggggggggggttgtttgtttgtttctgtttaaatccgtcgtgtttttgtttttaatttgcccctttctcctccctcctccctttttatgaaacttgaacacttgaaggactgctgtgtatttgtaaataacaaaagtagtgtgcactttgtgcttgtaaagtccctggtccagccgctactcctacagcccacgtcgccaaggacgcgcggtctgtgtttcatgtcccctccttcttcggtgtgaacgtgtgggaccagaccttgttctcggggtgtgcccgagtcactttaaccacaaaaacacccccgccatcgtcgtcagggtaaggtcactctgcagagacccgtgagcccatccaagactttttggctgggccacagtgtttataagggggtcatatgggctctttttaatggcctgcctgtttttaaattgtgttgctgtttctttctttatggagcaaaaagagagaaagaaaacttgcatttaatttatttgcacaaatgcagaaagcgtattctatctaaattattacgtaaatattggaatgtatatttttccacggggtgggcgggaggcgggcgtttctgctgacttgtctattctgtgttcatgccgctgcagacactgtgcaaggtagaattcaggtggctagagctggggacctcagacgaccagcttgcttcttctttttttctcttttctgtccccccccccccggctgctgtccctgcatgagaggactcccaccttctgctctggcctttctctctagatattctctctctttatatatatatctatatatttatttatctgacatacagatcatgacttcggtgagcagagaacactaacagtcaaattccccttctcttggacctgtctttggaaccatgttgattgagacaagggaaggttagcctggggcacatctgtggggtctaaccagacatctgggcttgagtcagtgggtaagaggctcctggtggcacatacacaatgcctctctatccttagcttattccaaacatagggcaagccagtgtcaacaaagatgatgcccaccttctgggaggggctgttgggggcagtatctagcaggcaagccctttgccctctttcgtccagttgacttctttgcccacacatggactttctcataatccctggatccctgtcctctgattatatcagcgactcaagcagactaagcccaaaagggctggcaggtgcctgtgcctgtttgtgggggtagcactgtccctatggggcctcacctggggcatggagaacccacaagtttccagccagtaccaccccacccccgaactcagtttcctctttctctcctccccatccccttttaactgatcctaaaccactaataactcagcccacaccccttatggccactgctgtgctccctctaacagaaacattctcaactcttgaaagatttttcagtaccggatggaaaatctggaatgtataggatcttgtgtccaaagtctctaaaaaaacaagccaaaaagcccctcaccaggtcacctcttccctcccgacctggcccagaggccggagagagagcaggcagggacaccagatgggccttcctgggtacacaacaaccctttcggctcagctgattaacccagcctggtggtgagggagagaggccagagctggcatcagagggaggtcttagaaaacactacccccaccccatgaattttcgggttttcttttcctttcttttttttatggttcccccacacacacccttccttttaacttacaagaaaataaggttgcaaccactcccggttaatggcttagtcactcctcttcgtttcagttttttggaaattaggagattatcctgtgagttactaaggatggtttattttcgagaaccacatcagatagggaatgagttatgggtaactctagatgaaaatgacccttcccccccccccgggagaggtttctcgaaggcatggatgcaaaatataaaatattaaaaaaaagtctaaataaagcttattttaaaataaaaaaaaaaaaaaaaaaaaaaaaaagg

SEQ ID NO: 609 - DNA, 23 bp, Artificial Sequence
  Synthetic
agcgcuuaaagggcgagaagatt

SEQ ID NO: 610 - DNA, 23 bp, Artificial Sequence
  Synthetic
ucuucucgcccuuuaagcgcutt

SEQ ID NO: 611 - DNA, 23 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
  misc_feature (21)..(21): 2'-O-Methyl
agcgcuuaaagggcgagaagatt

SEQ ID NO: 612 - DNA, 23 bp, Artificial Sequence
  Synthetic
  misc_feature (7)..(7): 2'-O-Methyl
  misc_feature (15)..(15): 2'-O-Methyl
  misc_feature (19)..(19): 2'-O-Methyl
agcgcuuaaagggcgagaagatt

SEQ ID NO: 613 - DNA, 23 bp, Artificial Sequence
  Synthetic
  misc_feature (14)..(14): 2'-O-Methyl
ucuucucgcccuuuaagcgcutt

SEQ ID NO: 614 - DNA, 23 bp, Artificial Sequence
  Synthetic
  misc_feature (7)..(7): 2'-O-Methyl
agcgcuuaaagggcgagaagatt

SEQ ID NO: 615 - DNA, 23 bp, Artificial Sequence
  Synthetic
  misc_feature (14)..(14): 2'-O-Methyl
ucuucucgcccuuuaagcgcutt

SEQ ID NO: 616 - DNA, 21 bp, Artificial Sequence
  Synthetic
ggccuuucucucuagauautt

SEQ ID NO: 617 - DNA, 21 bp, Artificial Sequence
  Synthetic
auaucuagagagaaaggcctt

SEQ ID NO: 618 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggccuuucucucuagauautt

SEQ ID NO: 619 - DNA, 21 bp, Artificial Sequence
  Synthetic
  misc_feature (13)..(13): 2'-O-Methyl
  misc_feature (17)..(17): 2'-O-Methyl
ggccuuucucucuagauautt

SEQ ID NO: 620 - DNA, 21 bp, Artificial Sequence
  Synthetic
  misc_feature (2)..(2): 2'-O-Methyl
  misc_feature (6)..(6): 2'-O-Methyl
auaucuagagagaaaggcctt

SEQ ID NO: 621 - DNA, 21 bp, Artificial Sequence
  Synthetic
  misc_feature (2)..(2): 2'-O-Methyl
  misc_feature (6)..(6): 2'-O-Methyl
auaucuagagagaaaggcctt

SEQ ID NO: 622 - DNA, 21 bp, Artificial Sequence
  Synthetic
gccucucuauccuuagcuutt

SEQ ID NO: 623 - DNA, 21 bp, Artificial Sequence
  Synthetic
aagcuaaggauagagaggctt

SEQ ID NO: 624 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
gccucucuauccuuagcuutt

SEQ ID NO: 625 - DNA, 21 bp, Artificial Sequence
  Synthetic
  misc_feature (12)..(12): 2'-Fluoro
aagcuaaggauagagaggctt

SEQ ID NO: 626 - DNA, 21 bp, Artificial Sequence
  Synthetic
  misc_feature (5)..(5): 2'-Fluoro
  misc_feature (8)..(8): 2'-Fluoro
  misc_feature (14)..(14): 2'-Fluoro
gccucucuauccuuagcuutt

SEQ ID NO: 627 - DNA, 21 bp, Artificial Sequence
  Synthetic
  misc_feature (5)..(5): 2'-Fluoro
  misc_feature (11)..(11): 2'-Fluoro
aagcuaaggauagagaggctt

SEQ ID NO: 628 - DNA, 21 bp, Artificial Sequence
  Synthetic
  misc_feature (5)..(5): 2'-Fluoro
  misc_feature (12)..(12): 2'-Fluoro
aagcuaaggauagagaggctt

SEQ ID NO: 629 - DNA, 21 bp, Artificial Sequence
  Synthetic
aaggaccuagaggagucactt

SEQ ID NO: 630 - DNA, 21 bp, Artificial Sequence
  Synthetic
gugacuccucuagguccuutt

SEQ ID NO: 631 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
aaggaccuagaggagucactt

SEQ ID NO: 632 - DNA, 21 bp, Artificial Sequence
  Synthetic
  misc_feature (8)..(8): 2'-Fluoro
  misc_feature (17)..(17): 2'-Fluoro
aaggaccuagaggagucactt

SEQ ID NO: 633 - DNA, 21 bp, Artificial Sequence
  Synthetic
  misc_feature (2)..(2): 2'-Fluoro
  misc_feature (11)..(11): 2'-Fluoro
gugacuccucuagguccuutt

SEQ ID NO: 634 - DNA, 21 bp, Artificial Sequence
  Synthetic
  misc_feature (8)..(8): 2'-Fluoro
aaggaccuagaggagucactt

SEQ ID NO: 635 - DNA, 21 bp, Artificial Sequence
  Synthetic
  misc_feature (11)..(11): 2'-Fluoro
gugacuccucuagguccuutt

SEQ ID NO: 636 - DNA, 21 bp, Artificial Sequence
  Synthetic
cugaccggaagcgcuuaaatt

SEQ ID NO: 637 - DNA, 21 bp, Artificial Sequence
  Synthetic
uuuaagcgcuuccggucagtt

SEQ ID NO: 638 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
cugaccggaagcgcuuaaatt

SEQ ID NO: 639 - DNA, 21 bp, Artificial Sequence
  Synthetic
  misc_feature (9)..(9): 2'-O-Methyl
  misc_feature (13)..(13): 2'-O-Methyl
  misc_feature (17)..(17): 2'-O-Methyl
uuuaagcgcuuccggucagtt

SEQ ID NO: 640 - DNA, 21 bp, Artificial Sequence
  Synthetic
  misc_feature (2)..(2): 2'-O-Methyl
  misc_feature (16)..(16): 2'-O-Methyl
cugaccggaagcgcuuaaatt

SEQ ID NO: 641 - DNA, 21 bp, Artificial Sequence
  Synthetic
  misc_feature (3)..(3): 2'-O-Methyl
  misc_feature (17)..(17): 2'-O-Methyl
uuuaagcgcuuccggucagtt

SEQ ID NO: 642 - DNA, 21 bp, Artificial Sequence
  Synthetic
  misc_feature (16)..(16): 2'-O-Methyl
cugaccggaagcgcuuaaatt

SEQ ID NO: 643 - DNA, 21 bp, Artificial Sequence
  Synthetic
  misc_feature (3)..(3): 2'-O-Methyl
uuuaagcgcuuccggucagtt

SEQ ID NO: 644 - DNA, 21 bp, Artificial Sequence
  Synthetic
uuaaagggcgagaagaccgtt

SEQ ID NO: 645 - DNA, 21 bp, Artificial Sequence
  Synthetic
cggucuucucgcccuuuaatt

SEQ ID NO: 646 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuaaagggcgagaagaccgtt

SEQ ID NO: 647 - DNA, 21 bp, Artificial Sequence
  Synthetic
  misc_feature (2)..(3): 2'-O-Methyl
  misc_feature (7)..(7): 2'-O-Methyl
uuaaagggcgagaagaccgtt

SEQ ID NO: 648 - DNA, 21 bp, Artificial Sequence
  Synthetic
  misc_feature (17)..(17): 2'-O-Methyl
cggucuucucgcccuuuaatt

SEQ ID NO: 649 - DNA, 21 bp, Artificial Sequence
  Synthetic
  misc_feature (2)..(2): 2'-O-Methyl
uuaaagggcgagaagaccgtt

SEQ ID NO: 650 - DNA, 21 bp, Artificial Sequence
  Synthetic
  misc_feature (17)..(17): 2'-O-Methyl
cggucuucucgcccuuuaatt

SEQ ID NO: 651 - DNA, 21 bp, Artificial Sequence
  Synthetic
gaagagccuacacaacccutt

SEQ ID NO: 652 - DNA, 21 bp, Artificial Sequence
  Synthetic
aggguuguguaggcucuuctt

SEQ ID NO: 653 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaagagccuacacaacccutt

SEQ ID NO: 654 - DNA, 21 bp, Artificial Sequence
  Synthetic
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aggguuguguaggcucuuctt

SEQ ID NO: 655 - DNA, 21 bp, Artificial Sequence
  Synthetic
  misc_feature (9)..(9): 2'-O-Methyl
  misc_feature (11)..(11): 2'-O-Methyl
  misc_feature (13)..(13): 2'-O-Methyl
gaagagccuacacaacccutt

SEQ ID NO: 656 - DNA, 21 bp, Artificial Sequence
  Synthetic
  misc_feature (6)..(6): 2'-O-Methyl
  misc_feature (8)..(8): 2'-O-Methyl
  misc_feature (10)..(10): 2'-O-Methyl
aggguuguguaggcucuuctt

SEQ ID NO: 657 - DNA, 21 bp, Artificial Sequence
  Synthetic
  misc_feature (9)..(9): 2'-O-Methyl
  misc_feature (11)..(11): 2'-O-Methyl
gaagagccuacacaacccutt

SEQ ID NO: 658 - DNA, 21 bp, Artificial Sequence
  Synthetic
  misc_feature (8)..(8): 2'-O-Methyl
  misc_feature (10)..(10): 2'-O-Methyl
aggguuguguaggcucuuctt

SEQ ID NO: 659 - DNA, 21 bp, Artificial Sequence
  Synthetic
cuagaggaucuugaagacctt

SEQ ID NO: 660 - DNA, 21 bp, Artificial Sequence
  Synthetic
ggucuucaagauccucuagtt

SEQ ID NO: 661 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
cuagaggaucuugaagacctt

SEQ ID NO: 662 - DNA, 21 bp, Artificial Sequence
  Synthetic
  misc_feature (2)..(2): 2'-Fluoro
  misc_feature (8)..(8): 2'-Fluoro
  misc_feature (12)..(12): 2'-Fluoro
cuagaggaucuugaagacctt

SEQ ID NO: 663 - DNA, 21 bp, Artificial Sequence
  Synthetic
  misc_feature (17)..(17): 2'-Fluoro
ggucuucaagauccucuagtt

SEQ ID NO: 664 - DNA, 21 bp, Artificial Sequence
  Synthetic
  misc_feature (2)..(2): 2'-Fluoro
cuagaggaucuugaagacctt

SEQ ID NO: 665 - DNA, 21 bp, Artificial Sequence
  Synthetic
acauagaggaagacgcggatt

SEQ ID NO: 666 - DNA, 21 bp, Artificial Sequence
  Synthetic
uccgcgucuuccucuaugutt

SEQ ID NO: 667 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
acauagaggaagacgcggatt

SEQ ID NO: 668 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
uccgcgucuuccucuaugutt

SEQ ID NO: 669 - DNA, 21 bp, Artificial Sequence
  Synthetic
  misc_feature (2)..(2): 2'-Fluoro
  misc_feature (4)..(4): 2'-Fluoro
  misc_feature (7)..(7): 2'-Fluoro
acauagaggaagacgcggatt

SEQ ID NO: 670 - DNA, 21 bp, Artificial Sequence
  Synthetic
  misc_feature (15)..(15): 2'-Fluoro
  misc_feature (17)..(17): 2'-Fluoro
uccgcgucuuccucuaugutt

SEQ ID NO: 671 - DNA, 21 bp, Artificial Sequence
  Synthetic
  misc_feature (15)..(15): 2'-Fluoro
uccgcgucuuccucuaugutt

SEQ ID NO: 672 - DNA, 21 bp, Artificial Sequence
  Synthetic
aucgucgucaggguaaggutt

SEQ ID NO: 673 - DNA, 21 bp, Artificial Sequence
  Synthetic
accuuacccugacgacgautt

SEQ ID NO: 674 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aucgucgucaggguaaggutt

SEQ ID NO: 675 - DNA, 21 bp, Artificial Sequence
  Synthetic
  misc_feature (15)..(15): 2'-O-Methyl
  misc_feature (17)..(17): 2'-O-Methyl
  misc_feature (19)..(19): 2'-O-Methyl
accuuacccugacgacgautt

SEQ ID NO: 676 - DNA, 21 bp, Artificial Sequence
  Synthetic
  misc_feature (9)..(9): 2'-O-Methyl
  misc_feature (14)..(14): 2'-O-Methyl
aucgucgucaggguaaggutt

SEQ ID NO: 677 - DNA, 21 bp, Artificial Sequence
  Synthetic
  misc_feature (5)..(5): 2'-O-Methyl
  misc_feature (10)..(10): 2'-O-Methyl
accuuacccugacgacgautt

SEQ ID NO: 678 - DNA, 21 bp, Artificial Sequence
  Synthetic
  misc_feature (14)..(14): 2'-O-Methyl
aucgucgucaggguaaggutt

SEQ ID NO: 679 - DNA, 21 bp, Artificial Sequence
  Synthetic
  misc_feature (5)..(5): 2'-O-Methyl
accuuacccugacgacgautt

SEQ ID NO: 680 - DNA, 21 bp, Artificial Sequence
  Synthetic
cucuggccuuucucucuagtt

SEQ ID NO: 681 - DNA, 21 bp, Artificial Sequence
  Synthetic
cuagagagaaaggccagagtt

SEQ ID NO: 682 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cucuggccuuucucucuagtt

SEQ ID NO: 683 - DNA, 21 bp, Artificial Sequence
  Synthetic
  misc_feature (4)..(4): 2'-O-Methyl
  misc_feature (17)..(17): 2'-O-Methyl
cucuggccuuucucucuagtt

SEQ ID NO: 684 - DNA, 21 bp, Artificial Sequence
  Synthetic
  misc_feature (15)..(15): 2'-O-Methyl
cuagagagaaaggccagagtt

SEQ ID NO: 685 - DNA, 21 bp, Artificial Sequence
  Synthetic
  misc_feature (17)..(17): 2'-O-Methyl
cucuggccuuucucucuagtt

SEQ ID NO: 686 - DNA, 21 bp, Artificial Sequence
  Synthetic
gacaagggaagguuagccutt

SEQ ID NO: 687 - DNA, 21 bp, Artificial Sequence
  Synthetic
aggcuaaccuucccuuguctt

SEQ ID NO: 688 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gacaagggaagguuagccutt

SEQ ID NO: 689 - DNA, 21 bp, Artificial Sequence
  Synthetic
  misc_feature (3)..(3): 2'-O-Methyl
  misc_feature (14)..(14): 2'-O-Methyl
gacaagggaagguuagccutt

SEQ ID NO: 690 - DNA, 21 bp, Artificial Sequence
  Synthetic
  misc_feature (5)..(5): 2'-O-Methyl
  misc_feature (16)..(16): 2'-O-Methyl
aggcuaaccuucccuuguctt

SEQ ID NO: 691 - DNA, 21 bp, Artificial Sequence
  Synthetic
  misc_feature (14)..(14): 2'-O-Methyl
gacaagggaagguuagccutt

SEQ ID NO: 692 - DNA, 21 bp, Artificial Sequence
  Synthetic
  misc_feature (5)..(5): 2'-O-Methyl
aggcuaaccuucccuuguctt

SEQ ID NO: 693 - DNA, 21 bp, Artificial Sequence
  Synthetic
agacuaagcccaaaagggctt

SEQ ID NO: 694 - DNA, 21 bp, Artificial Sequence
  Synthetic
gcccuuuugggcuuagucutt

SEQ ID NO: 695 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
agacuaagcccaaaagggctt

SEQ ID NO: 696 - DNA, 21 bp, Artificial Sequence
  Synthetic
  misc_feature (5)..(5): 2'-Fluoro
  misc_feature (11)..(11): 2'-Fluoro
agacuaagcccaaaagggctt

SEQ ID NO: 697 - DNA, 21 bp, Artificial Sequence
  Synthetic
  misc_feature (8)..(8): 2'-Fluoro
  misc_feature (14)..(14): 2'-Fluoro
gcccuuuugggcuuagucutt

SEQ ID NO: 698 - DNA, 21 bp, Artificial Sequence
  Synthetic
  misc_feature (5)..(5): 2'-Fluoro
agacuaagcccaaaagggctt

SEQ ID NO: 699 - DNA, 21 bp, Artificial Sequence
  Synthetic
  misc_feature (14)..(14): 2'-Fluoro
gcccuuuugggcuuagucutt

SEQ ID NO: 700 - DNA, 21 bp, Artificial Sequence
  Synthetic
ccuccccauccccuuuuaatt

SEQ ID NO: 701 - DNA, 21 bp, Artificial Sequence
  Synthetic
uuaaaaggggauggggaggtt

SEQ ID NO: 702 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ccuccccauccccuuuuaatt

SEQ ID NO: 703 - DNA, 21 bp, Artificial Sequence
  Synthetic
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuaaaaggggauggggaggtt

SEQ ID NO: 704 - DNA, 21 bp, Artificial Sequence
  Synthetic
  misc_feature (7)..(7): 2'-O-Methyl
  misc_feature (17)..(17): 2'-O-Methyl
ccuccccauccccuuuuaatt

SEQ ID NO: 705 - DNA, 21 bp, Artificial Sequence
  Synthetic
  misc_feature (3)..(3): 2'-O-Methyl
  misc_feature (12)..(12): 2'-O-Methyl
uuaaaaggggauggggaggtt

SEQ ID NO: 706 - DNA, 21 bp, Artificial Sequence
  Synthetic
  misc_feature (3)..(3): 2'-O-Methyl
uuaaaaggggauggggaggtt

SEQ ID NO: 707 - DNA, 21 bp, Artificial Sequence
  Synthetic
aucagagggaggucuuagatt

SEQ ID NO: 708 - DNA, 21 bp, Artificial Sequence
  Synthetic
ucuaagaccucccucugautt

SEQ ID NO: 709 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aucagagggaggucuuagatt

SEQ ID NO: 710 - DNA, 21 bp, Artificial Sequence
  Synthetic
  misc_feature (6)..(6): 2'-O-Methyl
  misc_feature (15)..(15): 2'-O-Methyl
  misc_feature (17)..(17): 2'-O-Methyl
  misc_feature (19)..(19): 2'-O-Methyl
ucuaagaccucccucugautt

SEQ ID NO: 711 - DNA, 21 bp, Artificial Sequence
  Synthetic
  misc_feature (3)..(3): 2'-O-Methyl
  misc_feature (16)..(16): 2'-O-Methyl
aucagagggaggucuuagatt

SEQ ID NO: 712 - DNA, 21 bp, Artificial Sequence
  Synthetic
  misc_feature (3)..(3): 2'-O-Methyl
  misc_feature (16)..(16): 2'-O-Methyl
ucuaagaccucccucugautt

SEQ ID NO: 713 - DNA, 21 bp, Artificial Sequence
  Synthetic
  misc_feature (16)..(16): 2'-O-Methyl
aucagagggaggucuuagatt

SEQ ID NO: 714 - DNA, 21 bp, Artificial Sequence
  Synthetic
  misc_feature (3)..(3): 2'-O-Methyl
ucuaagaccucccucugautt

SEQ ID NO: 715 - DNA, 21 bp, Artificial Sequence
  Synthetic
gggaggucuuagaaaacactt

SEQ ID NO: 716 - DNA, 21 bp, Artificial Sequence
  Synthetic
guguuuucuaagaccuccctt

SEQ ID NO: 717 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gggaggucuuagaaaacactt

SEQ ID NO: 718 - DNA, 21 bp, Artificial Sequence
  Synthetic
  misc_feature (10)..(10): 2'-O-Methyl
  misc_feature (17)..(17): 2'-O-Methyl
gggaggucuuagaaaacactt

SEQ ID NO: 719 - DNA, 21 bp, Artificial Sequence
  Synthetic
  misc_feature (9)..(9): 2'-O-Methyl
guguuuucuaagaccuccctt

SEQ ID NO: 720 - DNA, 21 bp, Artificial Sequence
  Synthetic
  misc_feature (9)..(9): 2'-O-Methyl
guguuuucuaagaccuccctt

SEQ ID NO: 721 - DNA, 21 bp, Artificial Sequence
  Synthetic
ggcuuagucacuccucuuctt

SEQ ID NO: 722 - DNA, 21 bp, Artificial Sequence
  Synthetic
gaagaggagugacuaagcctt

SEQ ID NO: 723 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
ggcuuagucacuccucuuctt

SEQ ID NO: 724 - DNA, 21 bp, Artificial Sequence
  Synthetic
  misc_feature (5)..(5): 2'-Fluoro
  misc_feature (9)..(9): 2'-Fluoro
ggcuuagucacuccucuuctt

SEQ ID NO: 725 - DNA, 21 bp, Artificial Sequence
  Synthetic
  misc_feature (10)..(10): 2'-Fluoro
  misc_feature (14)..(14): 2'-Fluoro
gaagaggagugacuaagcctt

SEQ ID NO: 726 - DNA, 21 bp, Artificial Sequence
  Synthetic
  misc_feature (5)..(5): 2'-Fluoro
ggcuuagucacuccucuuctt

SEQ ID NO: 727 - DNA, 21 bp, Artificial Sequence
  Synthetic
  misc_feature (14)..(14): 2'-Fluoro
gaagaggagugacuaagcctt

SEQ ID NO: 728 - DNA, 903 bp, Rattus norvegicus
gatcatgggtgctacggcgctgcccccgatctggcagatgtaccttaaggaccaccggatctacaccttcaagaactggcccttcctggaggattgctcctgcaccccagagcggatggcggaggctggcttcatccactgccctaccgagaatgagcctgatttggcccagtgttttttctgctttaaggaactggaaggctgggaaccggatgacaaccctatagaggagcataggaagcactcccctggctgcgccttccttacagtcaagaagcaggtggaagaactgaccgtcagcgagtttttgaaactggacaaacaaagagccaagaacaaaattgcaaaggagaccaacaacaaacagaaagagttcgaggagacccggaggaccgtccggcagtccattgagcagctggctgccttacgctgagcctttgctgggcaacctggacctgagtgacatgccacggctaagccacttgtcccagctttccaggcctgcctggccgccttggtgtcttacaggagaccgtgacatttcgaaactggacgtcagatgatttggggttttgctttaaaggggctcagcctgcgtggccacctctctttggttttgtggctttgctctattgtgacctggacttaagcactgaggaagggagtggatgagggacaggattctctgacaggatctatgggtggggaggggggtgaagggagggttgtgcaaggcctttctggtcttgatgtttccatgcctggcagctgtcgcagcccatgtgtaggtgttggtttatatatgtttgtgctgataattcttcttctgtccttctgatgagtcctcctaccatggggtaatggaataaaataacttaacaaaaaaaaaaaaaaaaaaaaaaa

SEQ ID NO: 729 - DNA, 21 bp, Artificial Sequence
  Synthetic
accuuaaggaccaccggautt

SEQ ID NO: 730 - DNA, 21 bp, Artificial Sequence
  Synthetic
auccggugguccuuaaggutt

SEQ ID NO: 731 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
accuuaaggaccaccggautt

SEQ ID NO: 732 - DNA, 21 bp, Artificial Sequence
  Synthetic
  misc_feature (4)..(4): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
auccggugguccuuaaggutt

SEQ ID NO: 733 - DNA, 21 bp, Artificial Sequence
  Synthetic
  misc_feature (5)..(5): 2'-O-Methyl
  misc_feature (12)..(12): 2'-O-Methyl
accuuaaggaccaccggautt

SEQ ID NO: 734 - DNA, 21 bp, Artificial Sequence
  Synthetic
  misc_feature (7)..(7): 2'-O-Methyl
  misc_feature (14)..(14): 2'-O-Methyl
auccggugguccuuaaggutt

SEQ ID NO: 735 - DNA, 21 bp, Artificial Sequence
  Synthetic
  misc_feature (5)..(5): 2'-O-Methyl
accuuaaggaccaccggautt

SEQ ID NO: 736 - DNA, 21 bp, Artificial Sequence
  Synthetic
  misc_feature (14)..(14): 2'-O-Methyl
auccggugguccuuaaggutt

SEQ ID NO: 737 - DNA, 21 bp, Artificial Sequence
  Synthetic
cggaucuacaccuucaagatt

SEQ ID NO: 738 - DNA, 21 bp, Artificial Sequence
  Synthetic
ucuugaagguguagauccgtt

SEQ ID NO: 739 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cggaucuacaccuucaagatt

SEQ ID NO: 740 - DNA, 21 bp, Artificial Sequence
  Synthetic
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ucuugaagguguagauccgtt

SEQ ID NO: 741 - DNA, 21 bp, Artificial Sequence
  Synthetic
  misc_feature (7)..(7): 2'-O-Methyl
  misc_feature (9)..(9): 2'-O-Methyl
  misc_feature (15)..(15): 2'-O-Methyl
cggaucuacaccuucaagatt

SEQ ID NO: 742 - DNA, 21 bp, Artificial Sequence
  Synthetic
  misc_feature (4)..(4): 2'-O-Methyl
  misc_feature (10)..(10): 2'-O-Methyl
  misc_feature (12)..(12): 2'-O-Methyl
ucuugaagguguagauccgtt

SEQ ID NO: 743 - DNA, 21 bp, Artificial Sequence
  Synthetic
  misc_feature (7)..(7): 2'-O-Methyl
cggaucuacaccuucaagatt

SEQ ID NO: 744 - DNA, 21 bp, Artificial Sequence
  Synthetic
  misc_feature (12)..(12): 2'-O-Methyl
ucuugaagguguagauccgtt

SEQ ID NO: 745 - DNA, 21 bp, Artificial Sequence
  Synthetic
uaccgagaaugagccugautt

SEQ ID NO: 746 - DNA, 21 bp, Artificial Sequence
  Synthetic
aucaggcucauucucgguatt

SEQ ID NO: 747 - DNA, 21 bp, Artificial Sequence
  Synthetic
  misc_feature (12)..(12): 2'-O-Methyl
  misc_feature (14)..(14): 2'-O-Methyl
  misc_feature (16)..(16): 2'-O-Methyl
  misc_feature (18)..(18): 2'-O-Methyl
uaccgagaaugagccugautt

SEQ ID NO: 748 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aucaggcucauucucgguatt

SEQ ID NO: 749 - DNA, 21 bp, Artificial Sequence
  Synthetic
  misc_feature (1)..(1): 2'-O-Methyl
  misc_feature (10)..(10): 2'-O-Methyl
  misc_feature (16)..(16): 2'-O-Methyl
uaccgagaaugagccugautt

SEQ ID NO: 750 - DNA, 21 bp, Artificial Sequence
  Synthetic
  misc_feature (3)..(3): 2'-O-Methyl
  misc_feature (9)..(9): 2'-O-Methyl
  misc_feature (18)..(18): 2'-O-Methyl
aucaggcucauucucgguatt

SEQ ID NO: 751 - DNA, 21 bp, Artificial Sequence
  Synthetic oligonucleotide - OMe-
  misc_feature (1)..(1): 2'-O-Methyl
uaccgagaaugagccugautt

SEQ ID NO: 752 - DNA, 21 bp, Artificial Sequence
  Synthetic
  misc_feature (18)..(18): 2'-O-Methyl
aucaggcucauucucgguatt

SEQ ID NO: 753 - DNA, 21 bp, Artificial Sequence
  Synthetic
gcuuuaaggaacuggaaggtt

SEQ ID NO: 754 - DNA, 21 bp, Artificial Sequence
  Synthetic
ccuuccaguuccuuaaagctt

SEQ ID NO: 755 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gcuuuaaggaacuggaaggtt

SEQ ID NO: 756 - DNA, 21 bp, Artificial Sequence
  Synthetic
  misc_feature (2)..(2): 2'-O-Methyl
  misc_feature (4)..(4): 2'-O-Methyl
  misc_feature (6)..(6): 2'-O-Methyl
  misc_feature (8)..(8): 2'-O-Methyl
  misc_feature (10)..(10): 2'-O-Methyl
ccuuccaguuccuuaaagctt

SEQ ID NO: 757 - DNA, 21 bp, Artificial Sequence
  Synthetic
  misc_feature (5)..(5): 2'-O-Methyl
  misc_feature (13)..(13): 2'-O-Methyl
gcuuuaaggaacuggaaggtt

SEQ ID NO: 758 - DNA, 21 bp, Artificial Sequence
  Synthetic
  misc_feature (6)..(6): 2'-O-Methyl
  misc_feature (14)..(14): 2'-O-Methyl
ccuuccaguuccuuaaagctt

SEQ ID NO: 759 - DNA, 21 bp, Artificial Sequence
  Synthetic
  misc_feature (14)..(14): 2'-O-Methyl
ccuuccaguuccuuaaagctt

SEQ ID NO: 760 - DNA, 21 bp, Artificial Sequence
  Synthetic
uccucgucgucuguucuaatt

SEQ ID NO: 761 - DNA, 21 bp, Artificial Sequence
  Synthetic
uuagaacagacgacgaggatt

SEQ ID NO: 762 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uccucgucgucuguucuaatt

SEQ ID NO: 763 - DNA, 21 bp, Artificial Sequence
  Synthetic
  misc_feature (3)..(3): 2'-O-Methyl
  misc_feature (5)..(5): 2'-O-Methyl
  misc_feature (17)..(17): 2'-O-Methyl
  misc_feature (19)..(19): 2'-O-Methyl
uuagaacagacgacgaggatt

SEQ ID NO: 764 - DNA, 21 bp, Artificial Sequence
  Synthetic
  misc_feature (8)..(8): 2'-O-Methyl
  misc_feature (12)..(12): 2'-O-Methyl
  misc_feature (17)..(17): 2'-O-Methyl
uccucgucgucuguucuaatt

SEQ ID NO: 765 - DNA, 21 bp, Artificial Sequence
  Synthetic
  misc_feature (2)..(2): 2'-O-Methyl
  misc_feature (7)..(7): 2'-O-Methyl
uuagaacagacgacgaggatt

SEQ ID NO: 766 - DNA, 21 bp, Artificial Sequence
  Synthetic
  misc_feature (17)..(17): 2'-O-Methyl
uccucgucgucuguucuaatt

SEQ ID NO: 767 - DNA, 21 bp, Artificial Sequence
  Synthetic
  misc_feature (2)..(2): 2'-O-Methyl
uuagaacagacgacgaggatt

SEQ ID NO: 768 - DNA, 21 bp, Artificial Sequence
  Synthetic
uucuaaccgggcagcuucutt

SEQ ID NO: 769 - DNA, 21 bp, Artificial Sequence
  Synthetic
agaagcugcccgguuagaatt

SEQ ID NO: 770 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uucuaaccgggcagcuucutt

SEQ ID NO: 771 - DNA, 21 bp, Artificial Sequence
  Synthetic
  misc_feature (4)..(4): 2'-Fluoro
  misc_feature (12)..(12): 2'-Fluoro
uucuaaccgggcagcuucutt

SEQ ID NO: 772 - DNA, 21 bp, Artificial Sequence
  Synthetic
  misc_feature (7)..(7): 2'-Fluoro
  misc_feature (15)..(15): 2'-Fluoro
agaagcugcccgguuagaatt

SEQ ID NO: 773 - DNA, 21 bp, Artificial Sequence
  Synthetic
  misc_feature (4)..(4): 2'-Fluoro
uucuaaccgggcagcuucutt

SEQ ID NO: 774 - DNA, 21 bp, Artificial Sequence
  Synthetic
  misc_feature (15)..(15): 2'-Fluoro
agaagcugcccgguuagaatt

SEQ ID NO: 775 - DNA, 21 bp, Artificial Sequence
  Synthetic
gaggauggauucgacuuagtt

SEQ ID NO: 776 - DNA, 21 bp, Artificial Sequence
  Synthetic
cuaagucgaauccauccuctt

SEQ ID NO: 777 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
gaggauggauucgacuuagtt

SEQ ID NO: 778 - DNA, 21 bp, Artificial Sequence
  Synthetic
  misc_feature (2)..(2): 2'-O-Methyl
  misc_feature (6)..(6): 2'-O-Methyl
  misc_feature (11)..(11): 2'-O-Methyl
cuaagucgaauccauccuctt

SEQ ID NO: 779 - DNA, 21 bp, Artificial Sequence
  Synthetic
  misc_feature (6)..(6): 2'-O-Methyl
  misc_feature (14)..(14): 2'-O-Methyl
  misc_feature (17)..(17): 2'-O-Methyl
gaggauggauucgacuuagtt

SEQ ID NO: 780 - DNA, 21 bp, Artificial Sequence
  Synthetic
  misc_feature (2)..(2): 2'-O-Methyl
  misc_feature (5)..(5): 2'-O-Methyl
  misc_feature (13)..(13): 2'-O-Methyl
cuaagucgaauccauccuctt

SEQ ID NO: 781 - DNA, 21 bp, Artificial Sequence
  Synthetic
  misc_feature (2)..(2): 2'-O-Methyl
cuaagucgaauccauccuctt

SEQ ID NO: 782 - DNA, 21 bp, Artificial Sequence
  Synthetic
uaaagcuggaaagggacggtt

SEQ ID NO: 783 - DNA, 21 bp, Artificial Sequence
  Synthetic
ccgucccuuuccagcuuuatt

SEQ ID NO: 784 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uaaagcuggaaagggacggtt

SEQ ID NO: 785 - DNA, 21 bp, Artificial Sequence
  Synthetic
  misc_feature (13)..(13): 2'-O-Methyl
  misc_feature (19)..(19): 2'-O-Methyl
ccgucccuuuccagcuuuatt

SEQ ID NO: 786 - DNA, 21 bp, Artificial Sequence
  Synthetic
  misc_feature (1)..(1): 2'-O-Methyl
  misc_feature (7)..(7): 2'-O-Methyl
uaaagcuggaaagggacggtt

SEQ ID NO: 787 - DNA, 21 bp, Artificial Sequence
  Synthetic
  misc_feature (12)..(12): 2'-O-Methyl
  misc_feature (18)..(18): 2'-O-Methyl
ccgucccuuuccagcuuuatt

SEQ ID NO: 788 - DNA, 21 bp, Artificial Sequence
  Synthetic
  misc_feature (1)..(1): 2'-O-Methyl
uaaagcuggaaagggacggtt

SEQ ID NO: 789 - DNA, 21 bp, Artificial Sequence
  Synthetic
  misc_feature (18)..(18): 2'-O-Methyl
ccgucccuuuccagcuuuatt

SEQ ID NO: 790 - DNA, 21 bp, Artificial Sequence
  Synthetic
ggaaguaaggaccagagactt

SEQ ID NO: 791 - DNA, 21 bp, Artificial Sequence
  Synthetic
gucucugguccuuacuucctt

SEQ ID NO: 792 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggaaguaaggaccagagactt

SEQ ID NO: 793 - DNA, 21 bp, Artificial Sequence
  Synthetic
  misc_feature (1)..(1): 2'-O-Methyl
  misc_feature (7)..(8): 2'-O-Methyl
gucucugguccuuacuucctt

SEQ ID NO: 794 - DNA, 21 bp, Artificial Sequence
  Synthetic
  misc_feature (6)..(6): 2'-O-Methyl
  misc_feature (13)..(13): 2'-O-Methyl
ggaaguaaggaccagagactt

SEQ ID NO: 795 - DNA, 21 bp, Artificial Sequence
  Synthetic
  misc_feature (6)..(6): 2'-O-Methyl
  misc_feature (13)..(13): 2'-O-Methyl
gucucugguccuuacuucctt

SEQ ID NO: 796 - DNA, 21 bp, Artificial Sequence
  Synthetic
  misc_feature (6)..(6): 2'-O-Methyl
ggaaguaaggaccagagactt

SEQ ID NO: 797 - DNA, 21 bp, Artificial Sequence
  Synthetic
  misc_feature (13)..(13): 2'-O-Methyl
gucucugguccuuacuucctt

SEQ ID NO: 798 - DNA, 21 bp, Artificial Sequence
  Synthetic
aaggccaaccgauacuucutt

SEQ ID NO: 799 - DNA, 21 bp, Artificial Sequence
  Synthetic
agaaguaucgguuggccuutt

SEQ ID NO: 800 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaggccaaccgauacuucutt

SEQ ID NO: 801 - DNA, 21 bp, Artificial Sequence
  Synthetic
  misc_feature (6)..(6): 2'-O-Methyl
  misc_feature (8)..(8): 2'-O-Methyl
  misc_feature (12)..(13): 2'-O-Methyl
  misc_feature (18)..(19): 2'-O-Methyl
agaaguaucgguuggccuutt

SEQ ID NO: 802 - DNA, 21 bp, Artificial Sequence
  Synthetic
  misc_feature (2)..(2): 2'-O-Methyl
  misc_feature (6)..(6): 2'-O-Methyl
  misc_feature (13)..(13): 2'-O-Methyl
aaggccaaccgauacuucutt

SEQ ID NO: 803 - DNA, 21 bp, Artificial Sequence
  Synthetic
  misc_feature (6)..(6): 2'-O-Methyl
  misc_feature (13)..(13): 2'-O-Methyl
agaaguaucgguuggccuutt

SEQ ID NO: 804 - DNA, 21 bp, Artificial Sequence
  Synthetic
  misc_feature (13)..(13): 2'-O-Methyl
aaggccaaccgauacuucutt

SEQ ID NO: 805 - DNA, 21 bp, Artificial Sequence
  Synthetic
  misc_feature (6)..(6): 2'-O-Methyl
agaaguaucgguuggccuutt

SEQ ID NO: 806 - DNA, 21 bp, Artificial Sequence
  Synthetic
guucacguccuaccccuuutt

SEQ ID NO: 807 - DNA, 21 bp, Artificial Sequence
  Synthetic
aaagggguaggacgugaactt

SEQ ID NO: 808 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
guucacguccuaccccuuutt

SEQ ID NO: 809 - DNA, 21 bp, Artificial Sequence
  Synthetic
  misc_feature (13)..(13): 2'-Fluoro
  misc_feature (19)..(19): 2'-Fluoro
aaagggguaggacgugaactt

SEQ ID NO: 810 - DNA, 21 bp, Artificial Sequence
  Synthetic
  misc_feature (4)..(4): 2'-Fluoro
  misc_feature (11)..(11): 2'-Fluoro
guucacguccuaccccuuutt

SEQ ID NO: 811 - DNA, 21 bp, Artificial Sequence
  Synthetic
  misc_feature (8)..(8): 2'-Fluoro
  misc_feature (15)..(15): 2'-Fluoro
aaagggguaggacgugaactt

SEQ ID NO: 812 - DNA, 21 bp, Artificial Sequence
  Synthetic
  misc_feature (8)..(8): 2'-Fluoro
aaagggguaggacgugaactt

SEQ ID NO: 813 - DNA, 21 bp, Artificial Sequence
  Synthetic
agaguugggauuagggcuutt

SEQ ID NO: 814 - DNA, 21 bp, Artificial Sequence
  Synthetic
aagcccuaaucccaacucutt

SEQ ID NO: 815 - DNA, 21 bp, Artificial Sequence
  Synthetic
  misc_feature (17)..(17): 2'-O-Methyl
agaguugggauuagggcuutt

SEQ ID NO: 816 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aagcccuaaucccaacucutt

SEQ ID NO: 817 - DNA, 21 bp, Artificial Sequence
  Synthetic
  misc_feature (6)..(6): 2'-O-Methyl
  misc_feature (12)..(12): 2'-O-Methyl
agaguugggauuagggcuutt

SEQ ID NO: 818 - DNA, 21 bp, Artificial Sequence
  Synthetic
  misc_feature (7)..(7): 2'-O-Methyl
  misc_feature (13)..(13): 2'-O-Methyl
aagcccuaaucccaacucutt

SEQ ID NO: 819 - DNA, 21 bp, Artificial Sequence
  Synthetic
agaguugggauuagggcuutt

SEQ ID NO: 820 - DNA, 21 bp, Artificial Sequence
  Synthetic
  misc_feature (7)..(7): 2'-O-Methyl
aagcccuaaucccaacucutt

SEQ ID NO: 821 - DNA, 21 bp, Artificial Sequence
  Synthetic
uuacaaaggaucuccuccctt

SEQ ID NO: 822 - DNA, 21 bp, Artificial Sequence
  Synthetic
gggaggagauccuuuguaatt

SEQ ID NO: 823 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuacaaaggaucuccuccctt

SEQ ID NO: 824 - DNA, 21 bp, Artificial Sequence
  Synthetic
  misc_feature (11)..(12): 2'-O-Methyl
gggaggagauccuuuguaatt

SEQ ID NO: 825 - DNA, 21 bp, Artificial Sequence
  Synthetic
  misc_feature (2)..(2): 2'-O-Methyl
  misc_feature (4)..(4): 2'-O-Methyl
  misc_feature (10)..(10): 2'-O-Methyl
uuacaaaggaucuccuccctt

SEQ ID NO: 826 - DNA, 21 bp, Artificial Sequence
  Synthetic
  misc_feature (9)..(9): 2'-O-Methyl
  misc_feature (15)..(15): 2'-O-Methyl
  misc_feature (17)..(17): 2'-O-Methyl
gggaggagauccuuuguaatt

SEQ ID NO: 827 - DNA, 21 bp, Artificial Sequence
  Synthetic
  misc_feature (2)..(2): 2'-O-Methyl
uuacaaaggaucuccuccctt

SEQ ID NO: 828 - DNA, 21 bp, Artificial Sequence
  Synthetic
  misc_feature (17)..(17): 2'-O-Methyl
gggaggagauccuuuguaatt

SEQ ID NO: 829 - DNA, 21 bp, Artificial Sequence
  Synthetic
aacagccuuaccccgauuctt

SEQ ID NO: 830 - DNA, 21 bp, Artificial Sequence
  Synthetic
gaaucgggguaaggcuguutt

SEQ ID NO: 831 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aacagccuuaccccgauuctt

SEQ ID NO: 832 - DNA, 21 bp, Artificial Sequence
  Synthetic
  misc_feature (2)..(3): 2'-O-Methyl
  misc_feature (11)..(12): 2'-O-Methyl
gaaucgggguaaggcuguutt

SEQ ID NO: 833 - DNA, 21 bp, Artificial Sequence
  Synthetic
  misc_feature (3)..(3): 2'-O-Methyl
  misc_feature (9)..(9): 2'-O-Methyl
aacagccuuaccccgauuctt

SEQ ID NO: 834 - DNA, 21 bp, Artificial Sequence
  Synthetic
  misc_feature (10)..(10): 2'-O-Methyl
  misc_feature (16)..(16): 2'-O-Methyl
gaaucgggguaaggcuguutt

SEQ ID NO: 835 - DNA, 21 bp, Artificial Sequence
  Synthetic
  misc_feature (10)..(10): 2'-O-Methyl
gaaucgggguaaggcuguutt

SEQ ID NO: 836 - DNA, 21 bp, Artificial Sequence
  Synthetic
uuaccccgauucagccucutt

SEQ ID NO: 837 - DNA, 21 bp, Artificial Sequence
  Synthetic
agaggcugaaucgggguaatt

SEQ ID NO: 838 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uuaccccgauucagccucutt

SEQ ID NO: 839 - DNA, 21 bp, Artificial Sequence
  Synthetic
  misc_feature (2)..(2): 2'-Fluoro
  misc_feature (12)..(12): 2'-Fluoro
uuaccccgauucagccucutt

SEQ ID NO: 840 - DNA, 21 bp, Artificial Sequence
  Synthetic
  misc_feature (7)..(7): 2'-Fluoro
  misc_feature (17)..(17): 2'-Fluoro
agaggcugaaucgggguaatt

SEQ ID NO: 841 - DNA, 21 bp, Artificial Sequence
  Synthetic
  misc_feature (2)..(2): 2'-Fluoro
uuaccccgauucagccucutt

SEQ ID NO: 842 - DNA, 21 bp, Artificial Sequence
  Synthetic
  misc_feature (18)..(18): 2'-Fluoro
agaggcugaaucgggguaatt

SEQ ID NO: 843 - DNA, 21 bp, Artificial Sequence
  Synthetic
uaaccccaagaacgggcuutt

SEQ ID NO: 844 - DNA, 21 bp, Artificial Sequence
  Synthetic
aagcccguucuugggguuatt

SEQ ID NO: 845 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uaaccccaagaacgggcuutt

SEQ ID NO: 846 - DNA, 21 bp, Artificial Sequence
  Synthetic
  misc_feature (1)..(2): 2'-Fluoro
  misc_feature (19)..(19): 2'-Fluoro
aagcccguucuugggguuatt

SEQ ID NO: 847 - DNA, 21 bp, Artificial Sequence
  Synthetic
  misc_feature (1)..(1): 2'-Fluoro
  misc_feature (7)..(7): 2'-Fluoro
  misc_feature (13)..(13): 2'-Fluoro
uaaccccaagaacgggcuutt

SEQ ID NO: 848 - DNA, 21 bp, Artificial Sequence
  Synthetic
  misc_feature (7)..(7): 2'-Fluoro
  misc_feature (12)..(12): 2'-Fluoro
  misc_feature (18)..(18): 2'-Fluoro
aagcccguucuugggguuatt

SEQ ID NO: 849 - DNA, 21 bp, Artificial Sequence
  Synthetic
  misc_feature (1)..(1): 2'-Fluoro
uaaccccaagaacgggcuutt

SEQ ID NO: 850 - DNA, 21 bp, Artificial Sequence
  Synthetic
  misc_feature (18)..(18): 2'-Fluoro
aagcccguucuugggguuatt

SEQ ID NO: 851 - DNA, 1329 bp, Aspergillus fumigatus
atgagtcaaccacagagaggtggaggtatctctgccatcttcgtccatgtaggggcgggatatcacggccatggaaacgagagagcccaccttcaggtatgcgaaaacgcttgtaaagccgcaatgggcattttaaaaagcggtggatcagctctggatgctgttgagatggccatcattgtaatggaggatgacgagattacaaatgctggctatggaagcaacctgacgattgaaggagctgtcgaatgtgatgctactattgtcgaccaccatggcaggagcggcgcagctggagccgtctcgccgcgaatgctacttgaaacctctgcaaagcctttaacttgccacagagtgcctccaagcttcctcgttggtgagggtgcaacggactttgcttatgagcaaggattggtcatactgcctcctgacgggctcatatcgcgcttttcgaaagagagatggcaccgctggctgcaggatctcgaggctgctgaactagtcgaaagaaaacgggatccttcacgtttccgcatggaagaagatagagcatccttccttcgtcggccaatgctgaatcgtaatccagcccgcctcattgacaatacgcgtttacgcccacatctacccagctctcccttcaccggagtcgacttgctgaacccccttcctcgtctccaggctcttggaagcagacaaaccatagctcctgcaccaccagctatgccttcgaaccaaggacacggcatgggtcctgcaattggacaacctatggctgtggcaggtggacaaagtatggcttctgcacctgagcaaggtatggctgcctcggccaacacccatgcagatggtgcgactttccgcgcgtgccctacaaaagcaccttgtgcacctgacacttcgacgactgctcacccgggcgctgcagacgaggatgaagatatgatcagcgatacagtcggggccatagctgtagactgttatggcaatattgcggcaggttcttcgtctggcgggattggcgcgaagcatcgcggtcgaattgggcctgctgcgctggtgggcatcggcacctatgtgattcctgtggatcccagcgatcccgaacaagtatcagtcgcttcagttacatcgggcacaggcgagcacattgctacaactatggctgcgcagacgtcagctgcaagactctattactgtcaaaagaagtgtaaggacggtactttcgaaagtgtatccgaagacgaagctatgaatgcaatcatagccactgagttcatgggtgagttattgtattccatattccttacgaccattgatagagaataa

SEQ ID NO: 852 - DNA, 21 bp, Artificial Sequence
  Synthetic
cuagucgaaagaaaacgggtt

SEQ ID NO: 853 - DNA, 21 bp, Artificial Sequence
  Synthetic
cccguuuucuuucgacuagtt

SEQ ID NO: 854 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cuagucgaaagaaaacgggtt

SEQ ID NO: 855 - DNA, 21 bp, Artificial Sequence
  Synthetic
  misc_feature (15)..(15): 2'-O-Methyl
  misc_feature (18)..(18): 2'-O-Methyl
cccguuuucuuucgacuagtt

SEQ ID NO: 856 - DNA, 21 bp, Artificial Sequence
  Synthetic
  misc_feature (2)..(2): 2'-O-Methyl
  misc_feature (9)..(9): 2'-O-Methyl
  misc_feature (13)..(14): 2'-O-Methyl
cuagucgaaagaaaacgggtt

SEQ ID NO: 857 - DNA, 21 bp, Artificial Sequence
  Synthetic
  misc_feature (17)..(17): 2'-O-Methyl
cccguuuucuuucgacuagtt

SEQ ID NO: 858 - DNA, 21 bp, Artificial Sequence
  Synthetic
  misc_feature (2)..(2): 2'-O-Methyl
cuagucgaaagaaaacgggtt

SEQ ID NO: 859 - DNA, 21 bp, Artificial Sequence
  Synthetic
  misc_feature (17)..(17): 2'-O-Methyl
cccguuuucuuucgacuagtt

SEQ ID NO: 860 - DNA, 21 bp, Artificial Sequence
  Synthetic
aggacgguacuuucgaaagtt

SEQ ID NO: 861 - DNA, 21 bp, Artificial Sequence
  Synthetic
cuuucgaaaguaccguccutt

SEQ ID NO: 862 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aggacgguacuuucgaaagtt

SEQ ID NO: 863 - DNA, 21 bp, Artificial Sequence
  Synthetic
  misc_feature (2)..(4): 2'-O-Methyl
  misc_feature (11)..(11): 2'-O-Methyl
  misc_feature (16)..(16): 2'-O-Methyl
  misc_feature (19)..(19): 2'-O-Methyl
cuuucgaaaguaccguccutt

SEQ ID NO: 864 - DNA, 21 bp, Artificial Sequence
  Synthetic
  misc_feature (8)..(8): 2'-O-Methyl
  misc_feature (13)..(13): 2'-O-Methyl
  misc_feature (16)..(16): 2'-O-Methyl
aggacgguacuuucgaaagtt

SEQ ID NO: 865 - DNA, 21 bp, Artificial Sequence
  Synthetic
  misc_feature (11)..(11): 2'-O-Methyl
cuuucgaaaguaccguccutt

SEQ ID NO: 866 - DNA, 21 bp, Artificial Sequence
  Synthetic
  misc_feature (12)..(12): 2'-O-Methyl
cuuucgaaaguaccguccutt

SEQ ID NO: 867 - DNA, 21 bp, Artificial Sequence
  Synthetic
guauccgaagacgaagcuatt

SEQ ID NO: 868 - DNA, 21 bp, Artificial Sequence
  Synthetic
uagcuucgucuucggauactt

SEQ ID NO: 869 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
guauccgaagacgaagcuatt

SEQ ID NO: 870 - DNA, 21 bp, Artificial Sequence
  Synthetic
  misc_feature (2)..(2): 2'-O-Methyl
  misc_feature (16)..(16): 2'-O-Methyl
  misc_feature (18)..(18): 2'-O-Methyl
uagcuucgucuucggauactt

SEQ ID NO: 871 - DNA, 21 bp, Artificial Sequence
  Synthetic
  misc_feature (2)..(2): 2'-O-Methyl
  misc_feature (10)..(11): 2'-O-Methyl
  misc_feature (18)..(18): 2'-O-Methyl
guauccgaagacgaagcuatt

SEQ ID NO: 872 - DNA, 21 bp, Artificial Sequence
  Synthetic
  misc_feature (1)..(1): 2'-O-Methyl
  misc_feature (17)..(17): 2'-O-Methyl
uagcuucgucuucggauactt

SEQ ID NO: 873 - DNA, 21 bp, Artificial Sequence
  Synthetic
  misc_feature (18)..(18): 2'-O-Methyl
guauccgaagacgaagcuatt

SEQ ID NO: 874 - DNA, 21 bp, Artificial Sequence
  Synthetic
  misc_feature (1)..(1): 2'-O-Methyl
  misc_feature (17)..(17): 2'-O-Methyl
uagcuucgucuucggauactt

SEQ ID NO: 875 - DNA, 21 bp, Artificial Sequence
  Synthetic
agagagguggagguaucuctt

SEQ ID NO: 876 - DNA, 21 bp, Artificial Sequence
  Synthetic
gagauaccuccaccucucutt

SEQ ID NO: 877 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agagagguggagguaucuctt

SEQ ID NO: 878 - DNA, 21 bp, Artificial Sequence
  Synthetic
  misc_feature (12)..(12): 2'-O-Methyl
  misc_feature (16)..(16): 2'-O-Methyl
  misc_feature (18)..(18): 2'-O-Methyl
gagauaccuccaccucucutt

SEQ ID NO: 879 - DNA, 21 bp, Artificial Sequence
  Synthetic
  misc_feature (3)..(3): 2'-O-Methyl
  misc_feature (8)..(8): 2'-O-Methyl
  misc_feature (14)..(14): 2'-O-Methyl
agagagguggagguaucuctt

SEQ ID NO: 880 - DNA, 21 bp, Artificial Sequence
  Synthetic
  misc_feature (5)..(5): 2'-O-Methyl
  misc_feature (11)..(11): 2'-O-Methyl
  misc_feature (16)..(16): 2'-O-Methyl
gagauaccuccaccucucutt

SEQ ID NO: 881 - DNA, 21 bp, Artificial Sequence
  Synthetic
  misc_feature (14)..(14): 2'-O-Methyl
agagagguggagguaucuctt

SEQ ID NO: 882 - DNA, 21 bp, Artificial Sequence
  Synthetic
  misc_feature (5)..(5): 2'-O-Methyl
gagauaccuccaccucucutt

SEQ ID NO: 883 - DNA, 21 bp, Artificial Sequence
  Synthetic
gaaaacgcuuguaaagccgtt

SEQ ID NO: 884 - DNA, 21 bp, Artificial Sequence
  Synthetic
cggcuuuacaagcguuuuctt

SEQ ID NO: 885 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaaaacgcuuguaaagccgtt

SEQ ID NO: 886 - DNA, 21 bp, Artificial Sequence
  Synthetic
  misc_feature (8)..(8): 2'-O-Methyl
  misc_feature (10)..(11): 2'-O-Methyl
cggcuuuacaagcguuuuctt

SEQ ID NO: 887 - DNA, 21 bp, Artificial Sequence
  Synthetic
  misc_feature (10)..(10): 2'-O-Methyl
  misc_feature (12)..(12): 2'-O-Methyl
gaaaacgcuuguaaagccgtt

SEQ ID NO: 888 - DNA, 21 bp, Artificial Sequence
  Synthetic
  misc_feature (7)..(7): 2'-O-Methyl
  misc_feature (9)..(9): 2'-O-Methyl
cggcuuuacaagcguuuuctt

SEQ ID NO: 889 - DNA, 21 bp, Artificial Sequence
  Synthetic
  misc_feature (7)..(7): 2'-O-Methyl
cggcuuuacaagcguuuuctt

SEQ ID NO: 890 - DNA, 21 bp, Artificial Sequence
  Synthetic
gcugaacuagucgaaagaatt

SEQ ID NO: 891 - DNA, 21 bp, Artificial Sequence
  Synthetic
uucuuucgacuaguucagctt

SEQ ID NO: 892 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
gcugaacuagucgaaagaatt

SEQ ID NO: 893 - DNA, 21 bp, Artificial Sequence
  Synthetic
  misc_feature (9)..(9): 2'-Fluoro
  misc_feature (12)..(12): 2'-Fluoro
  misc_feature (17)..(17): 2'-Fluoro
uucuuucgacuaguucagctt

SEQ ID NO: 894 - DNA, 21 bp, Artificial Sequence
  Synthetic
  misc_feature (3)..(3): 2'-Fluoro
  misc_feature (8)..(8): 2'-Fluoro
gcugaacuagucgaaagaatt

SEQ ID NO: 895 - DNA, 21 bp, Artificial Sequence
  Synthetic
  misc_feature (11)..(11): 2'-Fluoro
  misc_feature (16)..(16): 2'-Fluoro
uucuuucgacuaguucagctt

SEQ ID NO: 896 - DNA, 21 bp, Artificial Sequence
  Synthetic
  misc_feature (8)..(8): 2'-Fluoro
gcugaacuagucgaaagaatt

SEQ ID NO: 897 - DNA, 21 bp, Artificial Sequence
  Synthetic
  misc_feature (11)..(11): 2'-Fluoro
uucuuucgacuaguucagctt

SEQ ID NO: 898 - DNA, 21 bp, Artificial Sequence
  Synthetic
ggaagaagauagagcaucctt

SEQ ID NO: 899 - DNA, 21 bp, Artificial Sequence
  Synthetic
ggaugcucuaucuucuucctt

SEQ ID NO: 900 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
ggaagaagauagagcaucctt

SEQ ID NO: 901 - DNA, 21 bp, Artificial Sequence
  Synthetic
  misc_feature (3)..(3): 2'-Fluoro
  misc_feature (10)..(10): 2'-Fluoro
ggaugcucuaucuucuucctt

SEQ ID NO: 902 - DNA, 21 bp, Artificial Sequence
  Synthetic
  misc_feature (10)..(10): 2'-Fluoro
  misc_feature (15)..(15): 2'-Fluoro
ggaagaagauagagcaucctt

SEQ ID NO: 903 - DNA, 21 bp, Artificial Sequence
  Synthetic
  misc_feature (4)..(4): 2'-Fluoro
  misc_feature (9)..(9): 2'-Fluoro
ggaugcucuaucuucuucctt

SEQ ID NO: 904 - DNA, 21 bp, Artificial Sequence
  Synthetic
  misc_feature (9)..(9): 2'-Fluoro
ggaugcucuaucuucuucctt

SEQ ID NO: 905 - DNA, 21 bp, Artificial Sequence
  Synthetic
aucuacccagcucucccuutt

SEQ ID NO: 906 - DNA, 21 bp, Artificial Sequence
  Synthetic
aagggagagcuggguagautt

SEQ ID NO: 907 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aucuacccagcucucccuutt

SEQ ID NO: 908 - DNA, 21 bp, Artificial Sequence
  Synthetic
  misc_feature (11)..(11): 2'-O-Methyl
  misc_feature (15)..(15): 2'-O-Methyl
  misc_feature (19)..(19): 2'-O-Methyl
aagggagagcuggguagautt

SEQ ID NO: 909 - DNA, 21 bp, Artificial Sequence
  Synthetic
  misc_feature (4)..(4): 2'-O-Methyl
  misc_feature (8)..(8): 2'-O-Methyl
  misc_feature (14)..(14): 2'-O-Methyl
aucuacccagcucucccuutt

SEQ ID NO: 910 - DNA, 21 bp, Artificial Sequence
  Synthetic
  misc_feature (11)..(11): 2'-O-Methyl
  misc_feature (15)..(15): 2'-O-Methyl
aagggagagcuggguagautt

SEQ ID NO: 911 - DNA, 21 bp, Artificial Sequence
  Synthetic
  misc_feature (4)..(4): 2'-O-Methyl
aucuacccagcucucccuutt

SEQ ID NO: 912 - DNA, 21 bp, Artificial Sequence
  Synthetic
  misc_feature (15)..(15): 2'-O-Methyl
aagggagagcuggguagautt

SEQ ID NO: 913 - DNA, 21 bp, Artificial Sequence
  Synthetic
agcgaucccgaacaaguautt

SEQ ID NO: 914 - DNA, 21 bp, Artificial Sequence
  Synthetic
auacuuguucgggaucgcutt

SEQ ID NO: 915 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agcgaucccgaacaaguautt

SEQ ID NO: 916 - DNA, 21 bp, Artificial Sequence
  Synthetic
  misc_feature (4)..(4): 2'-O-Methyl
  misc_feature (10)..(10): 2'-O-Methyl
  misc_feature (16)..(16): 2'-O-Methyl
  misc_feature (18)..(18): 2'-O-Methyl
auacuuguucgggaucgcutt

SEQ ID NO: 917 - DNA, 21 bp, Artificial Sequence
  Synthetic
  misc_feature (10)..(10): 2'-O-Methyl
  misc_feature (13)..(13): 2'-O-Methyl
  misc_feature (17)..(17): 2'-O-Methyl
agcgaucccgaacaaguautt

SEQ ID NO: 918 - DNA, 21 bp, Artificial Sequence
  Synthetic
  misc_feature (2)..(2): 2'-O-Methyl
  misc_feature (6)..(6): 2'-O-Methyl
auacuuguucgggaucgcutt

SEQ ID NO: 919 - DNA, 21 bp, Artificial Sequence
  Synthetic
  misc_feature (2)..(2): 2'-O-Methyl
auacuuguucgggaucgcutt

SEQ ID NO: 920 - DNA, 21 bp, Artificial Sequence
  Synthetic
cgaaaguguauccgaagactt

SEQ ID NO: 921 - DNA, 21 bp, Artificial Sequence
  Synthetic
gucuucggauacacuuucgtt

SEQ ID NO: 922 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cgaaaguguauccgaagactt

SEQ ID NO: 923 - DNA, 21 bp, Artificial Sequence
  Synthetic
  misc_feature (1)..(1): 2'-Fluoro
  misc_feature (7)..(8): 2'-Fluoro
  misc_feature (19)..(19): 2'-Fluoro
gucuucggauacacuuucgtt

SEQ ID NO: 924 - DNA, 21 bp, Artificial Sequence
  Synthetic
  misc_feature (7)..(7): 2'-Fluoro
  misc_feature (9)..(9): 2'-Fluoro
cgaaaguguauccgaagactt

SEQ ID NO: 925 - DNA, 21 bp, Artificial Sequence
  Synthetic
  misc_feature (10)..(10): 2'-Fluoro
  misc_feature (12)..(12): 2'-Fluoro
gucuucggauacacuuucgtt

SEQ ID NO: 926 - DNA, 21 bp, Artificial Sequence
  Synthetic
  misc_feature (10)..(10): 2'-Fluoro
gucuucggauacacuuucgtt

SEQ ID NO: 927 - DNA, 21 bp, Artificial Sequence
  Synthetic
ccgaagacgaagcuaugaatt

SEQ ID NO: 928 - DNA, 21 bp, Artificial Sequence
  Synthetic
uucauagcuucgucuucggtt

SEQ ID NO: 929 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
ccgaagacgaagcuaugaatt

SEQ ID NO: 930 - DNA, 21 bp, Artificial Sequence
  Synthetic
  misc_feature (7)..(7): 2'-Fluoro
  misc_feature (12)..(12): 2'-Fluoro
  misc_feature (18)..(19): 2'-Fluoro
uucauagcuucgucuucggtt

SEQ ID NO: 931 - DNA, 21 bp, Artificial Sequence
  Synthetic
  misc_feature (14)..(14): 2'-Fluoro
  misc_feature (16)..(16): 2'-Fluoro
ccgaagacgaagcuaugaatt

SEQ ID NO: 932 - DNA, 21 bp, Artificial Sequence
  Synthetic
  misc_feature (3)..(3): 2'-Fluoro
  misc_feature (5)..(5): 2'-Fluoro
uucauagcuucgucuucggtt

SEQ ID NO: 933 - DNA, 21 bp, Artificial Sequence
  Synthetic
  misc_feature (5)..(5): 2'-Fluoro
uucauagcuucgucuucggtt

SEQ ID NO: 934 - RNA, 19 nt, Artificial Sequence
  Synthetic
ucucccacccaauggagau

SEQ ID NO: 935 - DNA, 21 bp, Artificial Sequence
  Synthetic
aucuccauugggugggagatt

SEQ ID NO: 936 - RNA, 19 nt, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
ucucccacccaauggagau

SEQ ID NO: 937 - DNA, 21 bp, Artificial Sequence
  Synthetic
  misc_feature (1)..(1): 2'-O-Methyl
  misc_feature (7)..(7): 2'-O-Methyl
  misc_feature (17)..(17): 2'-O-Methyl
  misc_feature (19)..(19): 2'-O-Methyl
aucuccauugggugggagatt

SEQ ID NO: 938 - RNA, 19 nt, Artificial Sequence
  Synthetic
  misc_feature (6)..(6): 2'-O-Methyl
  misc_feature (10)..(11): 2'-O-Methyl
  misc_feature (13)..(13): 2'-O-Methyl
ucucccacccaauggagau

SEQ ID NO: 939 - DNA, 21 bp, Artificial Sequence
  Synthetic
  misc_feature (13)..(13): 2'-O-Methyl
aucuccauugggugggagatt

SEQ ID NO: 940 - RNA, 19 nt, Artificial Sequence
  Synthetic
  misc_feature (6)..(6): 2'-O-Methyl
  misc_feature (11)..(11): 2'-O-Methyl
ucucccacccaauggagau

SEQ ID NO: 941 - DNA, 21 bp, Artificial Sequence
  Synthetic
aaaccaggaaggggaaauctt

SEQ ID NO: 942 - DNA, 21 bp, Artificial Sequence
  Synthetic
gauuuccccuuccugguuutt

SEQ ID NO: 943 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
aaaccaggaaggggaaauctt

SEQ ID NO: 944 - DNA, 21 bp, Artificial Sequence
  Synthetic
  misc_feature (2)..(2): 2'-Fluoro
gauuuccccuuccugguuutt

SEQ ID NO: 945 - DNA, 21 bp, Artificial Sequence
  Synthetic
  misc_feature (5)..(6): 2'-Fluoro
  misc_feature (9)..(9): 2'-Fluoro
  misc_feature (12)..(12): 2'-Fluoro
aaaccaggaaggggaaauctt

SEQ ID NO: 946 - DNA, 21 bp, Artificial Sequence
  Synthetic
  misc_feature (14)..(15): 2'-Fluoro
gauuuccccuuccugguuutt

SEQ ID NO: 947 - DNA, 21 bp, Artificial Sequence
  Synthetic
  misc_feature (5)..(6): 2'-Fluoro
aaaccaggaaggggaaauctt

SEQ ID NO: 948 - DNA, 21 bp, Artificial Sequence
  Synthetic
gaaggggaaaucugugguutt

SEQ ID NO: 949 - DNA, 21 bp, Artificial Sequence
  Synthetic
aaccacagauuuccccuuctt

SEQ ID NO: 950 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaaggggaaaucugugguutt

SEQ ID NO: 951 - DNA, 21 bp, Artificial Sequence
  Synthetic
  misc_feature (13)..(16): 2'-O-Methyl
gaaggggaaaucugugguutt

SEQ ID NO: 952 - DNA, 21 bp, Artificial Sequence
  Synthetic
  misc_feature (4)..(7): 2'-O-Methyl
aaccacagauuuccccuuctt

SEQ ID NO: 953 - DNA, 21 bp, Artificial Sequence
  Synthetic
  misc_feature (13)..(13): 2'-O-Methyl
gaaggggaaaucugugguutt

SEQ ID NO: 954 - DNA, 21 bp, Artificial Sequence
  Synthetic
  misc_feature (4)..(4): 2'-O-Methyl
aaccacagauuuccccuuctt

SEQ ID NO: 955 - DNA, 21 bp, Artificial Sequence
  Synthetic
gggaggaugacaaagaagctt

SEQ ID NO: 956 - DNA, 21 bp, Artificial Sequence
  Synthetic
gcuucuuugucauccuccctt

SEQ ID NO: 957 - DNA, 21 bp, Artificial Sequence
  Synthetic
  misc_feature (2)..(2): 2'-Fluoro
  misc_feature (5)..(5): 2'-Fluoro
  misc_feature (11)..(11): 2'-Fluoro
  misc_feature (14)..(15): 2'-Fluoro
  misc_feature (17)..(19): 2'-Fluoro
gcuucuuugucauccuccctt

SEQ ID NO: 958 - DNA, 21 bp, Artificial Sequence
  Synthetic
  misc_feature (8)..(9): 2'-Fluoro
  misc_feature (11)..(11): 2'-Fluoro
gggaggaugacaaagaagctt

SEQ ID NO: 959 - DNA, 21 bp, Artificial Sequence
  Synthetic
  misc_feature (8)..(8): 2'-Fluoro
  misc_feature (11)..(11): 2'-Fluoro
gcuucuuugucauccuccctt

SEQ ID NO: 960 - DNA, 21 bp, Artificial Sequence
  Synthetic
  misc_feature (8)..(8): 2'-Fluoro
  misc_feature (11)..(11): 2'-Fluoro
gggaggaugacaaagaagctt

SEQ ID NO: 961 - DNA, 21 bp, Artificial Sequence
  Synthetic
  misc_feature (8)..(8): 2'-Fluoro
gcuucuuugucauccuccctt

SEQ ID NO: 962 - DNA, 21 bp, Artificial Sequence
  Synthetic
gaaacugguacuuuccccctt

SEQ ID NO: 963 - DNA, 21 bp, Artificial Sequence
  Synthetic
gggggaaaguaccaguuuctt

SEQ ID NO: 964 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaaacugguacuuuccccctt

SEQ ID NO: 965 - DNA, 21 bp, Artificial Sequence
  Synthetic
  misc_feature (6)..(7): 2'-O-Methyl
  misc_feature (9)..(9): 2'-O-Methyl
  misc_feature (12)..(12): 2'-O-Methyl
gaaacugguacuuuccccctt

SEQ ID NO: 966 - DNA, 21 bp, Artificial Sequence
  Synthetic
  misc_feature (10)..(10): 2'-O-Methyl
  misc_feature (13)..(14): 2'-O-Methyl
gggggaaaguaccaguuuctt

SEQ ID NO: 967 - DNA, 21 bp, Artificial Sequence
  Synthetic
  misc_feature (6)..(7): 2'-O-Methyl
  misc_feature (9)..(9): 2'-O-Methyl
gaaacugguacuuuccccctt

SEQ ID NO: 968 - DNA, 21 bp, Artificial Sequence
  Synthetic
  misc_feature (10)..(10): 2'-O-Methyl
gggggaaaguaccaguuuctt

SEQ ID NO: 969 - DNA, 21 bp, Artificial Sequence
  Synthetic
aucgcugcuccuccuccuctt

SEQ ID NO: 970 - DNA, 21 bp, Artificial Sequence
  Synthetic
gaggaggaggagcagcgautt

SEQ ID NO: 971 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
aucgcugcuccuccuccuctt

SEQ ID NO: 972 - DNA, 21 bp, Artificial Sequence
  Synthetic
  misc_feature (6)..(6): 2'-Fluoro
  misc_feature (9)..(9): 2'-Fluoro
  misc_feature (12)..(12): 2'-Fluoro
aucgcugcuccuccuccuctt

SEQ ID NO: 973 - DNA, 21 bp, Artificial Sequence
  Synthetic
  misc_feature (13)..(13): 2'-Fluoro
gaggaggaggagcagcgautt

SEQ ID NO: 974 - DNA, 21 bp, Artificial Sequence
  Synthetic
  misc_feature (6)..(6): 2'-Fluoro
aucgcugcuccuccuccuctt

SEQ ID NO: 975 - DNA, 21 bp, Artificial Sequence
  Synthetic
  misc_feature (13)..(13): 2'-Fluoro
gaggaggaggagcagcgautt

SEQ ID NO: 976 - DNA, 21 bp, Artificial Sequence
  Synthetic
agcucuuugucaccucucutt

SEQ ID NO: 977 - DNA, 21 bp, Artificial Sequence
  Synthetic
agagaggugacaaagagcutt

SEQ ID NO: 978 - DNA, 21 bp, Artificial Sequence
  Synthetic
  misc_feature (1)..(1): 2'-O-Methyl
  misc_feature (12)..(12): 2'-O-Methyl
agcucuuugucaccucucutt

SEQ ID NO: 979 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agagaggugacaaagagcutt

SEQ ID NO: 980 - DNA, 21 bp, Artificial Sequence
  Synthetic
  misc_feature (8)..(8): 2'-O-Methyl
  misc_feature (11)..(11): 2'-O-Methyl
  misc_feature (15)..(15): 2'-O-Methyl
  misc_feature (17)..(17): 2'-O-Methyl
agcucuuugucaccucucutt

SEQ ID NO: 981 - DNA, 21 bp, Artificial Sequence
  Synthetic
  misc_feature (8)..(8): 2'-O-Methyl
  misc_feature (11)..(11): 2'-O-Methyl
agagaggugacaaagagcutt

SEQ ID NO: 982 - DNA, 21 bp, Artificial Sequence
  Synthetic
  misc_feature (12)..(12): 2'-O-Methyl
agcucuuugucaccucucutt

SEQ ID NO: 983 - DNA, 21 bp, Artificial Sequence
  Synthetic
  misc_feature (11)..(12): 2'-O-Methyl
agagaggugacaaagagcutt

SEQ ID NO: 984 - DNA, 21 bp, Artificial Sequence
  Synthetic
aauaagcagcucgcgcucctt

SEQ ID NO: 985 - DNA, 21 bp, Artificial Sequence
  Synthetic
ggagcgcgagcugcuuauutt

SEQ ID NO: 986 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aauaagcagcucgcgcucctt

SEQ ID NO: 987 - DNA, 21 bp, Artificial Sequence
  Synthetic
  misc_feature (3)..(3): 2'-O-Methyl
  misc_feature (9)..(9): 2'-O-Methyl
  misc_feature (17)..(17): 2'-O-Methyl
ggagcgcgagcugcuuauutt

SEQ ID NO: 988 - DNA, 21 bp, Artificial Sequence
  Synthetic
  misc_feature (3)..(3): 2'-O-Methyl
  misc_feature (7)..(7): 2'-O-Methyl
  misc_feature (14)..(14): 2'-O-Methyl
aauaagcagcucgcgcucctt

SEQ ID NO: 989 - DNA, 21 bp, Artificial Sequence
  Synthetic oligonucleotide - OMe-
  misc_feature (12)..(12): 2'-O-Methyl
  misc_feature (16)..(16): 2'-O-Methyl
ggagcgcgagcugcuuauutt

SEQ ID NO: 990 - DNA, 21 bp, Artificial Sequence
  Synthetic oligonucleotide - OMe-
  misc_feature (3)..(3): 2'-O-Methyl
  misc_feature (7)..(7): 2'-O-Methyl
aauaagcagcucgcgcucctt

SEQ ID NO: 991 - DNA, 21 bp, Artificial Sequence
  Synthetic
  misc_feature (16)..(16): 2'-O-Methyl
ggagcgcgagcugcuuauutt

SEQ ID NO: 992 - DNA, 21 bp, Artificial Sequence
  Synthetic
cuagaggaucuugaagacctt

SEQ ID NO: 993 - DNA, 21 bp, Artificial Sequence
  Synthetic
ggucuucaagauccucuagtt

SEQ ID NO: 994 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cuagaggaucuugaagacctt

SEQ ID NO: 995 - DNA, 21 bp, Artificial Sequence
  Synthetic
  misc_feature (1)..(2): 2'-Fluoro
  misc_feature (10)..(10): 2'-Fluoro
  misc_feature (19)..(19): 2'-Fluoro
ggucuucaagauccucuagtt

SEQ ID NO: 996 - DNA, 21 bp, Artificial Sequence
  Synthetic
  misc_feature (2)..(2): 2'-Fluoro
  misc_feature (12)..(12): 2'-Fluoro
cuagaggaucuugaagacctt

SEQ ID NO: 997 - DNA, 21 bp, Artificial Sequence
  Synthetic
  misc_feature (7)..(7): 2'-Fluoro
  misc_feature (17)..(17): 2'-Fluoro
ggucuucaagauccucuagtt

SEQ ID NO: 998 - DNA, 21 bp, Artificial Sequence
  Synthetic
  misc_feature (7)..(7): 2'-Fluoro
  misc_feature (17)..(17): 2'-Fluoro
ggucuucaagauccucuagtt

SEQ ID NO: 999 - DNA, 21 bp, Artificial Sequence
  Synthetic
aucgaccugaaggaguacgtt

SEQ ID NO: 1000 - DNA, 21 bp, Artificial Sequence
  Synthetic
cguacuccuucaggucgautt

SEQ ID NO: 1001 - DNA, 21 bp, Artificial Sequence
  Synthetic
  misc_feature (2)..(3): 2'-O-Methyl
  misc_feature (6)..(8): 2'-O-Methyl
  misc_feature (16)..(16): 2'-O-Methyl
  misc_feature (18)..(18): 2'-O-Methyl
aucgaccugaaggaguacgtt

SEQ ID NO: 1002 - DNA, 21 bp, Artificial Sequence
  Synthetic
  misc_feature (1)..(1): 2'-O-Methyl
  misc_feature (3)..(3): 2'-O-Methyl
  misc_feature (5)..(11): 2'-O-Methyl
  misc_feature (15)..(16): 2'-O-Methyl
  misc_feature (19)..(19): 2'-O-Methyl
cguacuccuucaggucgautt

SEQ ID NO: 1003 - DNA, 21 bp, Artificial Sequence
  Synthetic
  misc_feature (4)..(4): 2'-O-Methyl
  misc_feature (8)..(8): 2'-O-Methyl
  misc_feature (16)..(16): 2'-O-Methyl
aucgaccugaaggaguacgtt

SEQ ID NO: 1004 - DNA, 21 bp, Artificial Sequence
  Synthetic
  misc_feature (3)..(3): 2'-O-Methyl
  misc_feature (11)..(11): 2'-O-Methyl
cguacuccuucaggucgautt

SEQ ID NO: 1005 - DNA, 21 bp, Artificial Sequence
  Synthetic
  misc_feature (8)..(8): 2'-O-Methyl
  misc_feature (16)..(16): 2'-O-Methyl
aucgaccugaaggaguacgtt

SEQ ID NO: 1006 - DNA, 21 bp, Artificial Sequence
  Synthetic
  misc_feature (5)..(5): 2'-O-Methyl
cguacuccuucaggucgautt

SEQ ID NO: 1007 - DNA, 21 bp, Artificial Sequence
  Synthetic
cccuccccuguccccgcuutt

SEQ ID NO: 1008 - DNA, 21 bp, Artificial Sequence
  Synthetic
aagcggggacaggggagggtt

SEQ ID NO: 1009 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cccuccccuguccccgcuutt

SEQ ID NO: 1010 - DNA, 21 bp, Artificial Sequence
  Synthetic
  misc_feature (1)..(2): 2'-Fluoro
  misc_feature (9)..(9): 2'-Fluoro
  misc_feature (11)..(11): 2'-Fluoro
  misc_feature (16)..(16): 2'-Fluoro
aagcggggacaggggagggtt

SEQ ID NO: 1011 - DNA, 21 bp, Artificial Sequence
  Synthetic
  misc_feature (9)..(9): 2'-Fluoro
  misc_feature (16)..(16): 2'-Fluoro
cccuccccuguccccgcuutt

SEQ ID NO: 1012 - DNA, 21 bp, Artificial Sequence
  Synthetic
  misc_feature (10)..(10): 2'-Fluoro
aagcggggacaggggagggtt

SEQ ID NO: 1013 - DNA, 21 bp, Artificial Sequence
  Synthetic
  misc_feature (9)..(9): 2'-Fluoro
cccuccccuguccccgcuutt

SEQ ID NO: 1014 - DNA, 21 bp, Artificial Sequence
  Synthetic
uuugaucagcggagacucgtt

SEQ ID NO: 1015 - DNA, 21 bp, Artificial Sequence
  Synthetic
cgagucuccgcugaucaaatt

SEQ ID NO: 1016 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuugaucagcggagacucgtt

SEQ ID NO: 1017 - DNA, 21 bp, Artificial Sequence
  Synthetic
  misc_feature (10)..(10): 2'-O-Methyl
  misc_feature (15)..(15): 2'-O-Methyl
cgagucuccgcugaucaaatt

SEQ ID NO: 1018 - DNA, 21 bp, Artificial Sequence
  Synthetic
  misc_feature (3)..(3): 2'-O-Methyl
  misc_feature (7)..(7): 2'-O-Methyl
uuugaucagcggagacucgtt

SEQ ID NO: 1019 - DNA, 21 bp, Artificial Sequence
  Synthetic
  misc_feature (12)..(12): 2'-O-Methyl
  misc_feature (16)..(16): 2'-O-Methyl
cgagucuccgcugaucaaatt

SEQ ID NO: 1020 - DNA, 21 bp, Artificial Sequence
  Synthetic
  misc_feature (4)..(4): 2'-O-Methyl
  misc_feature (7)..(7): 2'-O-Methyl
uuugaucagcggagacucgtt

SEQ ID NO: 1021 - DNA, 21 bp, Artificial Sequence
  Synthetic
aguuaacccgggacuuggatt

SEQ ID NO: 1022 - DNA, 21 bp, Artificial Sequence
  Synthetic
uccaagucccggguuaacutt

SEQ ID NO: 1023 - DNA, 21 bp, Artificial Sequence
  Synthetic
  misc_feature (1)..(1): 2'-O-Methyl
  misc_feature (3)..(4): 2'-O-Methyl
  misc_feature (6)..(6): 2'-O-Methyl
  misc_feature (8)..(8): 2'-O-Methyl
  misc_feature (10)..(10): 2'-O-Methyl
  misc_feature (12)..(12): 2'-O-Methyl
  misc_feature (14)..(14): 2'-O-Methyl
  misc_feature (16)..(16): 2'-O-Methyl
  misc_feature (18)..(18): 2'-O-Methyl
aguuaacccgggacuuggatt

SEQ ID NO: 1024 - DNA, 21 bp, Artificial Sequence
  Synthetic
  misc_feature (6)..(6): 2'-O-Methyl
  misc_feature (11)..(13): 2'-O-Methyl
uccaagucccggguuaacutt

SEQ ID NO: 1025 - DNA, 21 bp, Artificial Sequence
  Synthetic
  misc_feature (4)..(4): 2'-O-Methyl
  misc_feature (16)..(16): 2'-O-Methyl
aguuaacccgggacuuggatt

SEQ ID NO: 1026 - DNA, 21 bp, Artificial Sequence
  Synthetic
  misc_feature (3)..(3): 2'-O-Methyl
  misc_feature (15)..(15): 2'-O-Methyl
uccaagucccggguuaacutt

SEQ ID NO: 1027 - DNA, 21 bp, Artificial Sequence
  Synthetic
  misc_feature (4)..(4): 2'-O-Methyl
aguuaacccgggacuuggatt

SEQ ID NO: 1028 - DNA, 21 bp, Artificial Sequence
  Synthetic
  misc_feature (3)..(3): 2'-O-Methyl
uccaagucccggguuaacutt

SEQ ID NO: 1029 - DNA, 21 bp, Artificial Sequence
  Synthetic
aucacaaaccccuagagggtt

SEQ ID NO: 1030 - DNA, 21 bp, Artificial Sequence
  Synthetic
cccucuagggguuugugautt

SEQ ID NO: 1031 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aucacaaaccccuagagggtt

SEQ ID NO: 1032 - DNA, 21 bp, Artificial Sequence
  Synthetic
  misc_feature (7)..(7): 2'-O-Methyl
  misc_feature (18)..(18): 2'-O-Methyl
cccucuagggguuugugautt

SEQ ID NO: 1033 - DNA, 21 bp, Artificial Sequence
  Synthetic
  misc_feature (3)..(3): 2'-O-Methyl
  misc_feature (5)..(5): 2'-O-Methyl
  misc_feature (13)..(13): 2'-O-Methyl
aucacaaaccccuagagggtt

SEQ ID NO: 1034 - DNA, 21 bp, Artificial Sequence
  Synthetic
  misc_feature (6)..(6): 2'-O-Methyl
  misc_feature (14)..(14): 2'-O-Methyl
  misc_feature (16)..(16): 2'-O-Methyl
cccucuagggguuugugautt

SEQ ID NO: 1035 - DNA, 21 bp, Artificial Sequence
  Synthetic
  misc_feature (3)..(3): 2'-O-Methyl
  misc_feature (5)..(5): 2'-O-Methyl
aucacaaaccccuagagggtt

SEQ ID NO: 1036 - DNA, 21 bp, Artificial Sequence
  Synthetic
  misc_feature (6)..(6): 2'-O-Methyl
  misc_feature (16)..(16): 2'-O-Methyl
cccucuagggguuugugautt

SEQ ID NO: 1037 - DNA, 21 bp, Artificial Sequence
  Synthetic
aaaccccuagagggcaagutt

SEQ ID NO: 1038 - DNA, 21 bp, Artificial Sequence
  Synthetic
acuugcccucuagggguuutt

SEQ ID NO: 1039 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
acuugcccucuagggguuutt

SEQ ID NO: 1040 - DNA, 21 bp, Artificial Sequence
  Synthetic
  misc_feature (8)..(8): 2'-Fluoro
  misc_feature (15)..(15): 2'-Fluoro
  misc_feature (19)..(19): 2'-Fluoro
aaaccccuagagggcaagutt

SEQ ID NO: 1041 - DNA, 21 bp, Artificial Sequence
  Synthetic
  misc_feature (4)..(4): 2'-Fluoro
  misc_feature (11)..(11): 2'-Fluoro
acuugcccucuagggguuutt

SEQ ID NO: 1042 - DNA, 21 bp, Artificial Sequence
  Synthetic
  misc_feature (8)..(8): 2'-Fluoro
  misc_feature (15)..(15): 2'-Fluoro
aaaccccuagagggcaagutt

SEQ ID NO: 1043 - DNA, 23 bp, Artificial Sequence
  Synthetic
ggaaccucacaucaacgcgcatt

SEQ ID NO: 1044 - DNA, 23 bp, Artificial Sequence
  Synthetic
ugcgcguugaugugagguucctt

SEQ ID NO: 1045 - DNA, 23 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
  misc_feature (21)..(21): 2'-Fluoro
ggaaccucacaucaacgcgcatt

SEQ ID NO: 1046 - DNA, 23 bp, Artificial Sequence
  Synthetic
  misc_feature (10)..(10): 2'-Fluoro
  misc_feature (15)..(15): 2'-Fluoro
ugcgcguugaugugagguucctt

SEQ ID NO: 1047 - DNA, 23 bp, Artificial Sequence
  Synthetic
  misc_feature (8)..(8): 2'-Fluoro
  misc_feature (10)..(10): 2'-Fluoro
  misc_feature (13)..(13): 2'-Fluoro
  misc_feature (20)..(20): 2'-Fluoro
ggaaccucacaucaacgcgcatt

SEQ ID NO: 1048 - DNA, 23 bp, Artificial Sequence
  Synthetic
  misc_feature (1)..(1): 2'-Fluoro
  misc_feature (8)..(8): 2'-Fluoro
  misc_feature (11)..(11): 2'-Fluoro
  misc_feature (13)..(13): 2'-Fluoro
ugcgcguugaugugagguucctt

SEQ ID NO: 1049 - DNA, 23 bp, Artificial Sequence
  Synthetic
  misc_feature (8)..(8): 2'-Fluoro
ggaaccucacaucaacgcgcatt

SEQ ID NO: 1050 - DNA, 23 bp, Artificial Sequence
  Synthetic
  misc_feature (2)..(2): 2'-Fluoro
  misc_feature (8)..(8): 2'-Fluoro
  misc_feature (11)..(11): 2'-Fluoro
ugcgcguugaugugagguucctt

SEQ ID NO: 1051 - DNA, 21 bp, Artificial Sequence
  Synthetic
ugaacgucaccgaggagaatt

SEQ ID NO: 1052 - DNA, 21 bp, Artificial Sequence
  Synthetic
uucuccucggugacguucatt

SEQ ID NO: 1053 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ugaacgucaccgaggagaatt

SEQ ID NO: 1054 - DNA, 21 bp, Artificial Sequence
  Synthetic
  misc_feature (13)..(13): 2'-O-Methyl
  misc_feature (19)..(19): 2'-O-Methyl
uucuccucggugacguucatt

SEQ ID NO: 1055 - DNA, 21 bp, Artificial Sequence
  Synthetic
  misc_feature (1)..(1): 2'-O-Methyl
  misc_feature (8)..(8): 2'-O-Methyl
ugaacgucaccgaggagaatt

SEQ ID NO: 1056 - DNA, 21 bp, Artificial Sequence
  Synthetic
  misc_feature (11)..(11): 2'-O-Methyl
  misc_feature (18)..(18): 2'-O-Methyl
uucuccucggugacguucatt

SEQ ID NO: 1057 - DNA, 21 bp, Artificial Sequence
  Synthetic
  misc_feature (8)..(8): 2'-O-Methyl
ugaacgucaccgaggagaatt

SEQ ID NO: 1058 - DNA, 21 bp, Artificial Sequence
  Synthetic
  misc_feature (18)..(18): 2'-O-Methyl
uucuccucggugacguucatt

SEQ ID NO: 1059 - DNA, 21 bp, Artificial Sequence
  Synthetic
aacccaaaggggaguugcutt

SEQ ID NO: 1060 - DNA, 21 bp, Artificial Sequence
  Synthetic
agcaacuccccuuuggguutt

SEQ ID NO: 1061 - DNA, 21 bp, Artificial Sequence
  Synthetic
  misc_feature (3)..(5): 2'-O-Methyl
  misc_feature (18)..(18): 2'-O-Methyl
aacccaaaggggaguugcutt

SEQ ID NO: 1062 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agcaacuccccuuuggguutt

SEQ ID NO: 1063 - DNA, 21 bp, Artificial Sequence
  Synthetic
  misc_feature (5)..(5): 2'-O-Methyl
  misc_feature (12)..(12): 2'-O-Methyl
  misc_feature (16)..(16): 2'-O-Methyl
aacccaaaggggaguugcutt

SEQ ID NO: 1064 - DNA, 21 bp, Artificial Sequence
  Synthetic
  misc_feature (3)..(3): 2'-O-Methyl
  misc_feature (14)..(14): 2'-O-Methyl
agcaacuccccuuuggguutt

SEQ ID NO: 1065 - DNA, 21 bp, Artificial Sequence
  Synthetic
  misc_feature (16)..(16): 2'-O-Methyl
aacccaaaggggaguugcutt

SEQ ID NO: 1066 - DNA, 21 bp, Artificial Sequence
  Synthetic
  misc_feature (14)..(14): 2'-O-Methyl
agcaacuccccuuuggguutt

SEQ ID NO: 1067 - DNA, 21 bp, Artificial Sequence
  Synthetic
aaaggggaguugcuggaagtt

SEQ ID NO: 1068 - DNA, 21 bp, Artificial Sequence
  Synthetic
cuuccagcaacuccccuuutt

SEQ ID NO: 1069 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaaggggaguugcuggaagtt

SEQ ID NO: 1070 - DNA, 21 bp, Artificial Sequence
  Synthetic
  misc_feature (9)..(10): 2'-O-Methyl
cuuccagcaacuccccuuutt

SEQ ID NO: 1071 - DNA, 21 bp, Artificial Sequence
  Synthetic
  misc_feature (11)..(11): 2'-O-Methyl
  misc_feature (14)..(14): 2'-O-Methyl
aaaggggaguugcuggaagtt

SEQ ID NO: 1072 - DNA, 21 bp, Artificial Sequence
  Synthetic
  misc_feature (5)..(5): 2'-O-Methyl
  misc_feature (8)..(8): 2'-O-Methyl
cuuccagcaacuccccuuutt

SEQ ID NO: 1073 - DNA, 21 bp, Artificial Sequence
  Synthetic
  misc_feature (11)..(11): 2'-O-Methyl
aaaggggaguugcuggaagtt

SEQ ID NO: 1074 - DNA, 21 bp, Artificial Sequence
  Synthetic
  misc_feature (5)..(5): 2'-O-Methyl
cuuccagcaacuccccuuutt

SEQ ID NO: 1075 - DNA, 21 bp, Artificial Sequence
  Synthetic
aaacgugacuuugguuccutt

SEQ ID NO: 1076 - DNA, 21 bp, Artificial Sequence
  Synthetic
aggaaccaaagucacguuutt

SEQ ID NO: 1077 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaacgugacuuugguuccutt

SEQ ID NO: 1078 - DNA, 21 bp, Artificial Sequence
  Synthetic
  misc_feature (2)..(3): 2'-O-Methyl
  misc_feature (11)..(11): 2'-O-Methyl
  misc_feature (16)..(16): 2'-O-Methyl
aggaaccaaagucacguuutt

SEQ ID NO: 1079 - DNA, 21 bp, Artificial Sequence
  Synthetic
  misc_feature (6)..(6): 2'-O-Methyl
  misc_feature (12)..(12): 2'-O-Methyl
  misc_feature (18)..(18): 2'-O-Methyl
aaacgugacuuugguuccutt

SEQ ID NO: 1080 - DNA, 21 bp, Artificial Sequence
  Synthetic
  misc_feature (7)..(7): 2'-O-Methyl
  misc_feature (13)..(13): 2'-O-Methyl
aggaaccaaagucacguuutt

SEQ ID NO: 1081 - DNA, 21 bp, Artificial Sequence
  Synthetic
  misc_feature (12)..(12): 2'-O-Methyl
aaacgugacuuugguuccutt

SEQ ID NO: 1082 - DNA, 21 bp, Artificial Sequence
  Synthetic
  misc_feature (13)..(13): 2'-O-Methyl
aggaaccaaagucacguuutt

SEQ ID NO: 1083 - DNA, 21 bp, Artificial Sequence
  Synthetic
gaauaaccugaacgucacctt

SEQ ID NO: 1084 - DNA, 21 bp, Artificial Sequence
  Synthetic
ggugacguucagguuauuctt

SEQ ID NO: 1085 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaauaaccugaacgucacctt

SEQ ID NO: 1086 - DNA, 21 bp, Artificial Sequence
  Synthetic
  misc_feature (5)..(5): 2'-O-Methyl
  misc_feature (11)..(11): 2'-O-Methyl
  misc_feature (16)..(16): 2'-O-Methyl
ggugacguucagguuauuctt

SEQ ID NO: 1087 - DNA, 21 bp, Artificial Sequence
  Synthetic
  misc_feature (4)..(4): 2'-O-Methyl
  misc_feature (9)..(9): 2'-O-Methyl
  misc_feature (16)..(16): 2'-O-Methyl
gaauaaccugaacgucacctt

SEQ ID NO: 1088 - DNA, 21 bp, Artificial Sequence
  Synthetic
  misc_feature (3)..(3): 2'-O-Methyl
  misc_feature (10)..(10): 2'-O-Methyl
  misc_feature (15)..(15): 2'-O-Methyl
ggugacguucagguuauuctt

SEQ ID NO: 1089 - DNA, 21 bp, Artificial Sequence
  Synthetic
  misc_feature (4)..(4): 2'-O-Methyl
  misc_feature (16)..(16): 2'-O-Methyl
gaauaaccugaacgucacctt

SEQ ID NO: 1090 - DNA, 21 bp, Artificial Sequence
  Synthetic
  misc_feature (10)..(10): 2'-O-Methyl
ggugacguucagguuauuctt

SEQ ID NO: 1091 - DNA, 21 bp, Artificial Sequence
  Synthetic
acgucaccgaggagaaguatt

SEQ ID NO: 1092 - DNA, 21 bp, Artificial Sequence
  Synthetic
uacuucuccucggugacgutt

SEQ ID NO: 1093 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
acgucaccgaggagaaguatt

SEQ ID NO: 1094 - DNA, 21 bp, Artificial Sequence
  Synthetic
  misc_feature (12)..(13): 2'-O-Methyl
  misc_feature (15)..(15): 2'-O-Methyl
  misc_feature (18)..(18): 2'-O-Methyl
uacuucuccucggugacgutt

SEQ ID NO: 1095 - DNA, 21 bp, Artificial Sequence
  Synthetic
  misc_feature (5)..(5): 2'-O-Methyl
  misc_feature (18)..(19): 2'-O-Methyl
acgucaccgaggagaaguatt

SEQ ID NO: 1096 - DNA, 21 bp, Artificial Sequence
  Synthetic
  misc_feature (1)..(2): 2'-O-Methyl
  misc_feature (14)..(14): 2'-O-Methyl
uacuucuccucggugacgutt

SEQ ID NO: 1097 - DNA, 21 bp, Artificial Sequence
  Synthetic
  misc_feature (5)..(5): 2'-O-Methyl
acgucaccgaggagaaguatt

SEQ ID NO: 1098 - DNA, 21 bp, Artificial Sequence
  Synthetic
  misc_feature (1)..(1): 2'-O-Methyl
  misc_feature (14)..(14): 2'-O-Methyl
uacuucuccucggugacgutt

SEQ ID NO: 1099 - DNA, 21 bp, Artificial Sequence
  Synthetic
agaaguaccaggaggcguutt

SEQ ID NO: 1100 - DNA, 21 bp, Artificial Sequence
  Synthetic
aacgccuccugguacuucutt

SEQ ID NO: 1101 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
agaaguaccaggaggcguutt

SEQ ID NO: 1102 - DNA, 21 bp, Artificial Sequence
  Synthetic
  misc_feature (4)..(4): 2'-Fluoro
  misc_feature (11)..(12): 2'-Fluoro
aacgccuccugguacuucutt

SEQ ID NO: 1103 - DNA, 21 bp, Artificial Sequence
  Synthetic
  misc_feature (6)..(6): 2'-Fluoro
  misc_feature (9)..(9): 2'-Fluoro
agaaguaccaggaggcguutt

SEQ ID NO: 1104 - DNA, 21 bp, Artificial Sequence
  Synthetic
  misc_feature (10)..(10): 2'-Fluoro
  misc_feature (13)..(13): 2'-Fluoro
aacgccuccugguacuucutt

SEQ ID NO: 1105 - DNA, 21 bp, Artificial Sequence
  Synthetic
  misc_feature (6)..(6): 2'-Fluoro
agaaguaccaggaggcguutt

SEQ ID NO: 1106 - DNA, 21 bp, Artificial Sequence
  Synthetic
  misc_feature (10)..(10): 2'-Fluoro
aacgccuccugguacuucutt

SEQ ID NO: 1107 - DNA, 21 bp, Artificial Sequence
  Synthetic
aaaccucagcccuaacggutt

SEQ ID NO: 1108 - DNA, 21 bp, Artificial Sequence
  Synthetic
accguuagggcugagguuutt

SEQ ID NO: 1109 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaaccucagcccuaacggutt

SEQ ID NO: 1110 - DNA, 21 bp, Artificial Sequence
  Synthetic
  misc_feature (2)..(3): 2'-O-Methyl
  misc_feature (11)..(11): 2'-O-Methyl
accguuagggcugagguuutt

SEQ ID NO: 1111 - DNA, 21 bp, Artificial Sequence
  Synthetic
  misc_feature (7)..(7): 2'-O-Methyl
  misc_feature (13)..(13): 2'-O-Methyl
aaaccucagcccuaacggutt

SEQ ID NO: 1112 - DNA, 21 bp, Artificial Sequence
  Synthetic
  misc_feature (6)..(6): 2'-O-Methyl
  misc_feature (12)..(12): 2'-O-Methyl
accguuagggcugagguuutt

SEQ ID NO: 1113 - DNA, 21 bp, Artificial Sequence
  Synthetic
  misc_feature (8)..(8): 2'-O-Methyl
aaaccucagcccuaacggutt

SEQ ID NO: 1114 - DNA, 21 bp, Artificial Sequence
  Synthetic
  misc_feature (6)..(6): 2'-O-Methyl
accguuagggcugagguuutt

SEQ ID NO: 1115 - DNA, 21 bp, Artificial Sequence
  Synthetic
uuaaggagaagcugacggctt

SEQ ID NO: 1116 - DNA, 21 bp, Artificial Sequence
  Synthetic
gccgucagcuucuccuuaatt

SEQ ID NO: 1117 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuaaggagaagcugacggctt

SEQ ID NO: 1118 - DNA, 21 bp, Artificial Sequence
  Synthetic
  misc_feature (1)..(1): 2'-O-Methyl
  misc_feature (4)..(4): 2'-O-Methyl
  misc_feature (8)..(8): 2'-O-Methyl
gccgucagcuucuccuuaatt

SEQ ID NO: 1119 - DNA, 21 bp, Artificial Sequence
  Synthetic
  misc_feature (2)..(2): 2'-O-Methyl
  misc_feature (13)..(14): 2'-O-Methyl
uuaaggagaagcugacggctt

SEQ ID NO: 1120 - DNA, 21 bp, Artificial Sequence
  Synthetic
  misc_feature (6)..(6): 2'-O-Methyl
  misc_feature (17)..(17): 2'-O-Methyl
gccgucagcuucuccuuaatt

SEQ ID NO: 1121 - DNA, 21 bp, Artificial Sequence
  Synthetic
  misc_feature (2)..(2): 2'-O-Methyl
uuaaggagaagcugacggctt

SEQ ID NO: 1122 - DNA, 21 bp, Artificial Sequence
  Synthetic
  misc_feature (6)..(6): 2'-O-Methyl
  misc_feature (17)..(17): 2'-O-Methyl
gccgucagcuucuccuuaatt

SEQ ID NO: 1123 - DNA, 21 bp, Artificial Sequence
  Synthetic
aacuucugggagccuccaatt

SEQ ID NO: 1124 - DNA, 21 bp, Artificial Sequence
  Synthetic
uuggaggcucccagaaguutt

SEQ ID NO: 1125 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aacuucugggagccuccaatt

SEQ ID NO: 1126 - DNA, 21 bp, Artificial Sequence
  Synthetic
  misc_feature (5)..(5): 2'-O-Methyl
  misc_feature (13)..(13): 2'-O-Methyl
  misc_feature (15)..(16): 2'-O-Methyl
uuggaggcucccagaaguutt

SEQ ID NO: 1127 - DNA, 21 bp, Artificial Sequence
  Synthetic
  misc_feature (7)..(7): 2'-O-Methyl
  misc_feature (17)..(17): 2'-O-Methyl
aacuucugggagccuccaatt

SEQ ID NO: 1128 - DNA, 21 bp, Artificial Sequence
  Synthetic
  misc_feature (2)..(2): 2'-O-Methyl
  misc_feature (12)..(12): 2'-O-Methyl
uuggaggcucccagaaguutt

SEQ ID NO: 1129 - DNA, 21 bp, Artificial Sequence
  Synthetic
  misc_feature (17)..(17): 2'-O-Methyl
aacuucugggagccuccaatt

SEQ ID NO: 1130 - DNA, 21 bp, Artificial Sequence
  Synthetic
  misc_feature (12)..(12): 2'-O-Methyl
uuggaggcucccagaaguutt

SEQ ID NO: 1131 - DNA, 21 bp, Artificial Sequence
  Synthetic
ccagcgagcccaaaagaaatt

SEQ ID NO: 1132 - DNA, 21 bp, Artificial Sequence
  Synthetic
uuucuuuugggcucgcuggtt

SEQ ID NO: 1133 - DNA, 21 bp, Artificial Sequence
  Synthetic
  misc_feature (4)..(4): 2'-Fluoro
  misc_feature (6)..(6): 2'-Fluoro
  misc_feature (8)..(8): 2'-Fluoro
  misc_feature (16)..(16): 2'-Fluoro
ccagcgagcccaaaagaaatt

SEQ ID NO: 1134 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uuucuuuugggcucgcuggtt

SEQ ID NO: 1135 - DNA, 21 bp, Artificial Sequence
  Synthetic
  misc_feature (2)..(2): 2'-Fluoro
  misc_feature (11)..(11): 2'-Fluoro
  misc_feature (16)..(16): 2'-Fluoro
ccagcgagcccaaaagaaatt

SEQ ID NO: 1136 - DNA, 21 bp, Artificial Sequence
  Synthetic
  misc_feature (8)..(8): 2'-Fluoro
  misc_feature (17)..(17): 2'-Fluoro
uuucuuuugggcucgcuggtt

SEQ ID NO: 1137 - DNA, 21 bp, Artificial Sequence
  Synthetic
  misc_feature (2)..(2): 2'-Fluoro
  misc_feature (11)..(11): 2'-Fluoro
ccagcgagcccaaaagaaatt

SEQ ID NO: 1138 - DNA, 21 bp, Artificial Sequence
  Synthetic
cucaaaucaaggccggagutt

SEQ ID NO: 1139 - DNA, 21 bp, Artificial Sequence
  Synthetic
acuccggccuugauuugagtt

SEQ ID NO: 1140 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cucaaaucaaggccggagutt

SEQ ID NO: 1141 - DNA, 21 bp, Artificial Sequence
  Synthetic
  misc_feature (6)..(7): 2'-O-Methyl
  misc_feature (12)..(12): 2'-O-Methyl
  misc_feature (17)..(17): 2'-O-Methyl
  misc_feature (19)..(19): 2'-O-Methyl
acuccggccuugauuugagtt

SEQ ID NO: 1142 - DNA, 21 bp, Artificial Sequence
  Synthetic
  misc_feature (3)..(3): 2'-O-Methyl
  misc_feature (8)..(8): 2'-O-Methyl
cucaaaucaaggccggagutt

SEQ ID NO: 1143 - DNA, 21 bp, Artificial Sequence
  Synthetic
  misc_feature (11)..(11): 2'-O-Methyl
  misc_feature (16)..(16): 2'-O-Methyl
acuccggccuugauuugagtt

SEQ ID NO: 1144 - DNA, 21 bp, Artificial Sequence
  Synthetic
  misc_feature (11)..(11): 2'-O-Methyl
  misc_feature (16)..(16): 2'-O-Methyl
acuccggccuugauuugagtt

SEQ ID NO: 1145 - DNA, 21 bp, Artificial Sequence
  Synthetic
agccuccaaacuccuagcutt

SEQ ID NO: 1146 - DNA, 21 bp, Artificial Sequence
  Synthetic
agcuaggaguuuggaggcutt

SEQ ID NO: 1147 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agccuccaaacuccuagcutt

SEQ ID NO: 1148 - DNA, 21 bp, Artificial Sequence
  Synthetic
  misc_feature (3)..(3): 2'-O-Methyl
  misc_feature (18)..(18): 2'-O-Methyl
agcuaggaguuuggaggcutt

SEQ ID NO: 1149 - DNA, 21 bp, Artificial Sequence
  Synthetic
  misc_feature (7)..(7): 2'-O-Methyl
  misc_feature (15)..(15): 2'-O-Methyl
agccuccaaacuccuagcutt

SEQ ID NO: 1150 - DNA, 21 bp, Artificial Sequence
  Synthetic
  misc_feature (4)..(4): 2'-O-Methyl
  misc_feature (12)..(12): 2'-O-Methyl
agcuaggaguuuggaggcutt

SEQ ID NO: 1151 - DNA, 21 bp, Artificial Sequence
  Synthetic
  misc_feature (4)..(4): 2'-O-Methyl
  misc_feature (12)..(12): 2'-O-Methyl
agcuaggaguuuggaggcutt

SEQ ID NO: 1152 - DNA, 21 bp, Artificial Sequence
  Synthetic
auacuuggcgggcucuuuctt

SEQ ID NO: 1153 - DNA, 21 bp, Artificial Sequence
  Synthetic
gaaagagcccgccaaguautt

SEQ ID NO: 1154 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
auacuuggcgggcucuuuctt

SEQ ID NO: 1155 - DNA, 21 bp, Artificial Sequence
  Synthetic
  misc_feature (1)..(1): 2'-O-Methyl
  misc_feature (5)..(5): 2'-O-Methyl
  misc_feature (7)..(7): 2'-O-Methyl
  misc_feature (11)..(11): 2'-O-Methyl
  misc_feature (16)..(16): 2'-O-Methyl
gaaagagcccgccaaguautt

SEQ ID NO: 1156 - DNA, 21 bp, Artificial Sequence
  Synthetic
  misc_feature (2)..(2): 2'-O-Methyl
  misc_feature (6)..(7): 2'-O-Methyl
  misc_feature (13)..(13): 2'-O-Methyl
auacuuggcgggcucuuuctt

SEQ ID NO: 1157 - DNA, 21 bp, Artificial Sequence
  Synthetic
  misc_feature (13)..(13): 2'-O-Methyl
  misc_feature (17)..(17): 2'-O-Methyl
gaaagagcccgccaaguautt

SEQ ID NO: 1158 - DNA, 21 bp, Artificial Sequence
  Synthetic
  misc_feature (3)..(3): 2'-O-Methyl
auacuuggcgggcucuuuctt

SEQ ID NO: 1159 - DNA, 21 bp, Artificial Sequence
  Synthetic
  misc_feature (13)..(13): 2'-O-Methyl
gaaagagcccgccaaguautt

SEQ ID NO: 1160 - DNA, 21 bp, Artificial Sequence
  Synthetic
uuggggaagcggccggcggtt

SEQ ID NO: 1161 - DNA, 21 bp, Artificial Sequence
  Synthetic
ccgccggccgcuuccccaatt

SEQ ID NO: 1162 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuggggaagcggccggcggtt

SEQ ID NO: 1163 - DNA, 21 bp, Artificial Sequence
  Synthetic
  misc_feature (18)..(19): 2'-O-Methyl
ccgccggccgcuuccccaatt

SEQ ID NO: 1164 - DNA, 21 bp, Artificial Sequence
  Synthetic
  misc_feature (2)..(3): 2'-O-Methyl
  misc_feature (7)..(8): 2'-O-Methyl
uuggggaagcggccggcggtt

SEQ ID NO: 1165 - DNA, 21 bp, Artificial Sequence
  Synthetic
  misc_feature (17)..(17): 2'-O-Methyl
ccgccggccgcuuccccaatt

SEQ ID NO: 1166 - DNA, 21 bp, Artificial Sequence
  Synthetic
  misc_feature (2)..(2): 2'-O-Methyl
uuggggaagcggccggcggtt

SEQ ID NO: 1167 - DNA, 21 bp, Artificial Sequence
  Synthetic
  misc_feature (17)..(17): 2'-O-Methyl
ccgccggccgcuuccccaatt

SEQ ID NO: 1168 - DNA, 21 bp, Artificial Sequence
  Synthetic
aaggcaugcuucggaaacutt

SEQ ID NO: 1169 - DNA, 21 bp, Artificial Sequence
  Synthetic
aguuuccgaagcaugccuutt

SEQ ID NO: 1170 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaggcaugcuucggaaacutt

SEQ ID NO: 1171 - DNA, 21 bp, Artificial Sequence
  Synthetic
  misc_feature (2)..(2): 2'-O-Methyl
  misc_feature (11)..(11): 2'-O-Methyl
  misc_feature (15)..(15): 2'-O-Methyl
aguuuccgaagcaugccuutt

SEQ ID NO: 1172 - DNA, 21 bp, Artificial Sequence
  Synthetic
  misc_feature (5)..(5): 2'-O-Methyl
  misc_feature (7)..(8): 2'-O-Methyl
aaggcaugcuucggaaacutt

SEQ ID NO: 1173 - DNA, 21 bp, Artificial Sequence
  Synthetic
  misc_feature (12)..(12): 2'-O-Methyl
  misc_feature (14)..(14): 2'-O-Methyl
aguuuccgaagcaugccuutt

SEQ ID NO: 1174 - DNA, 21 bp, Artificial Sequence
  Synthetic
  misc_feature (5)..(5): 2'-O-Methyl
aaggcaugcuucggaaacutt

SEQ ID NO: 1175 - DNA, 21 bp, Artificial Sequence
  Synthetic
  misc_feature (12)..(12): 2'-O-Methyl
aguuuccgaagcaugccuutt

SEQ ID NO: 1176 - DNA, 21 bp, Artificial Sequence
  Synthetic
gcuucggaaacuggacauctt

SEQ ID NO: 1177 - DNA, 21 bp, Artificial Sequence
  Synthetic
gauguccaguuuccgaagctt

SEQ ID NO: 1178 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
gcuucggaaacuggacauctt

SEQ ID NO: 1179 - DNA, 21 bp, Artificial Sequence
  Synthetic
  misc_feature (1)..(1): 2'-Fluoro
  misc_feature (4)..(4): 2'-Fluoro
  misc_feature (9)..(9): 2'-Fluoro
  misc_feature (15)..(15): 2'-Fluoro
  misc_feature (18)..(18): 2'-Fluoro
gauguccaguuuccgaagctt

SEQ ID NO: 1180 - DNA, 21 bp, Artificial Sequence
  Synthetic
  misc_feature (12)..(13): 2'-Fluoro
  misc_feature (16)..(16): 2'-Fluoro
gcuucggaaacuggacauctt

SEQ ID NO: 1181 - DNA, 21 bp, Artificial Sequence
  Synthetic
  misc_feature (3)..(3): 2'-Fluoro
  misc_feature (7)..(8): 2'-Fluoro
gauguccaguuuccgaagctt

SEQ ID NO: 1182 - DNA, 21 bp, Artificial Sequence
  Synthetic
  misc_feature (16)..(16): 2'-Fluoro
gcuucggaaacuggacauctt

SEQ ID NO: 1183 - DNA, 21 bp, Artificial Sequence
  Synthetic
  misc_feature (3)..(3): 2'-Fluoro
  misc_feature (7)..(7): 2'-Fluoro
gauguccaguuuccgaagctt

SEQ ID NO: 1184 - DNA, 21 bp, Artificial Sequence
  Synthetic
aacucuacuguggagucggtt

SEQ ID NO: 1185 - DNA, 21 bp, Artificial Sequence
  Synthetic
ccgacuccacaguagaguutt

SEQ ID NO: 1186 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
aacucuacuguggagucggtt

SEQ ID NO: 1187 - DNA, 21 bp, Artificial Sequence
  Synthetic
  misc_feature (3)..(3): 2'-Fluoro
  misc_feature (12)..(12): 2'-Fluoro
  misc_feature (15)..(15): 2'-Fluoro
  misc_feature (17)..(17): 2'-Fluoro
ccgacuccacaguagaguutt

SEQ ID NO: 1188 - DNA, 21 bp, Artificial Sequence
  Synthetic
  misc_feature (6)..(6): 2'-Fluoro
  misc_feature (9)..(9): 2'-Fluoro
  misc_feature (11)..(11): 2'-Fluoro
aacucuacuguggagucggtt

SEQ ID NO: 1189 - DNA, 21 bp, Artificial Sequence
  Synthetic
  misc_feature (8)..(8): 2'-Fluoro
  misc_feature (10)..(10): 2'-Fluoro
  misc_feature (13)..(13): 2'-Fluoro
ccgacuccacaguagaguutt

SEQ ID NO: 1190 - DNA, 21 bp, Artificial Sequence
  Synthetic
  misc_feature (9)..(9): 2'-Fluoro
aacucuacuguggagucggtt

SEQ ID NO: 1191 - DNA, 21 bp, Artificial Sequence
  Synthetic
  misc_feature (8)..(8): 2'-Fluoro
  misc_feature (13)..(13): 2'-Fluoro
ccgacuccacaguagaguutt

SEQ ID NO: 1192 - DNA, 21 bp, Artificial Sequence
  Synthetic
agaaacgcaguaauccggatt

SEQ ID NO: 1193 - DNA, 21 bp, Artificial Sequence
  Synthetic
uccggauuacugcguuucutt

SEQ ID NO: 1194 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
agaaacgcaguaauccggatt

SEQ ID NO: 1195 - DNA, 21 bp, Artificial Sequence
  Synthetic
  misc_feature (4)..(5): 2'-O-Methyl
  misc_feature (12)..(12): 2'-O-Methyl
  misc_feature (14)..(14): 2'-O-Methyl
uccggauuacugcguuucutt

SEQ ID NO: 1196 - DNA, 21 bp, Artificial Sequence
  Synthetic
  misc_feature (8)..(8): 2'-O-Methyl
  misc_feature (11)..(12): 2'-O-Methyl
agaaacgcaguaauccggatt

SEQ ID NO: 1197 - DNA, 21 bp, Artificial Sequence
  Synthetic
  misc_feature (8)..(9): 2'-O-Methyl
  misc_feature (11)..(11): 2'-O-Methyl
uccggauuacugcguuucutt

SEQ ID NO: 1198 - DNA, 21 bp, Artificial Sequence
  Synthetic
  misc_feature (11)..(11): 2'-O-Methyl
agaaacgcaguaauccggatt

SEQ ID NO: 1199 - DNA, 21 bp, Artificial Sequence
  Synthetic
  misc_feature (11)..(11): 2'-O-Methyl
uccggauuacugcguuucutt

SEQ ID NO: 1200 - DNA, 21 bp, Artificial Sequence
  Synthetic
ggaaguccaccuucuccgatt

SEQ ID NO: 1201 - DNA, 21 bp, Artificial Sequence
  Synthetic
ucggagaagguggacuucctt

SEQ ID NO: 1202 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
ggaaguccaccuucuccgatt

SEQ ID NO: 1203 - DNA, 21 bp, Artificial Sequence
  Synthetic
  misc_feature (1)..(1): 2'-O-Methyl
  misc_feature (11)..(11): 2'-O-Methyl
  misc_feature (16)..(17): 2'-O-Methyl
ucggagaagguggacuucctt

SEQ ID NO: 1204 - DNA, 21 bp, Artificial Sequence
  Synthetic
  misc_feature (8)..(9): 2'-O-Methyl
  misc_feature (12)..(13): 2'-O-Methyl
ggaaguccaccuucuccgatt

SEQ ID NO: 1205 - DNA, 21 bp, Artificial Sequence
  Synthetic
  misc_feature (11)..(11): 2'-O-Methyl
ucggagaagguggacuucctt

SEQ ID NO: 1206 - DNA, 21 bp, Artificial Sequence
  Synthetic
  misc_feature (9)..(9): 2'-O-Methyl
ggaaguccaccuucuccgatt

SEQ ID NO: 1207 - DNA, 21 bp, Artificial Sequence
  Synthetic
  misc_feature (11)..(11): 2'-O-Methyl
ucggagaagguggacuucctt

SEQ ID NO: 1208 - DNA, 21 bp, Artificial Sequence
  Synthetic
cuccgacagaugaaggaaatt

SEQ ID NO: 1209 - DNA, 21 bp, Artificial Sequence
  Synthetic
uuuccuucaucugucggagtt

SEQ ID NO: 1210 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cuccgacagaugaaggaaatt

SEQ ID NO: 1211 - DNA, 21 bp, Artificial Sequence
  Synthetic
  misc_feature (9)..(9): 2'-O-Methyl
  misc_feature (18)..(18): 2'-O-Methyl
uuuccuucaucugucggagtt

SEQ ID NO: 1212 - DNA, 21 bp, Artificial Sequence
  Synthetic
  misc_feature (7)..(8): 2'-O-Methyl
  misc_feature (11)..(11): 2'-O-Methyl
cuccgacagaugaaggaaatt

SEQ ID NO: 1213 - DNA, 21 bp, Artificial Sequence
  Synthetic
  misc_feature (8)..(8): 2'-O-Methyl
  misc_feature (12)..(13): 2'-O-Methyl
uuuccuucaucugucggagtt

SEQ ID NO: 1214 - DNA, 21 bp, Artificial Sequence
  Synthetic
  misc_feature (11)..(11): 2'-O-Methyl
cuccgacagaugaaggaaatt

SEQ ID NO: 1215 - DNA, 21 bp, Artificial Sequence
  Synthetic
  misc_feature (12)..(12): 2'-O-Methyl
uuuccuucaucugucggagtt

SEQ ID NO: 1216 - DNA, 21 bp, Artificial Sequence
  Synthetic
aaggaccuagaggagucactt

SEQ ID NO: 1217 - DNA, 21 bp, Artificial Sequence
  Synthetic
gugacuccucuagguccuutt

SEQ ID NO: 1218 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaggaccuagaggagucactt

SEQ ID NO: 1219 - DNA, 21 bp, Artificial Sequence
  Synthetic
  misc_feature (1)..(1): 2'-O-Methyl
  misc_feature (3)..(3): 2'-O-Methyl
  misc_feature (13)..(14): 2'-O-Methyl
gugacuccucuagguccuutt

SEQ ID NO: 1220 - DNA, 21 bp, Artificial Sequence
  Synthetic
  misc_feature (8)..(8): 2'-O-Methyl
  misc_feature (17)..(18): 2'-O-Methyl
aaggaccuagaggagucactt

SEQ ID NO: 1221 - DNA, 21 bp, Artificial Sequence
  Synthetic
  misc_feature (2)..(2): 2'-O-Methyl
  misc_feature (11)..(11): 2'-O-Methyl
gugacuccucuagguccuutt

SEQ ID NO: 1222 - DNA, 21 bp, Artificial Sequence
  Synthetic
  misc_feature (8)..(8): 2'-O-Methyl
aaggaccuagaggagucactt

SEQ ID NO: 1223 - DNA, 21 bp, Artificial Sequence
  Synthetic
  misc_feature (2)..(2): 2'-O-Methyl
gugacuccucuagguccuutt

SEQ ID NO: 1224 - DNA, 21 bp, Artificial Sequence
  Synthetic
cugaccggaagcgcuuaaatt

SEQ ID NO: 1225 - DNA, 21 bp, Artificial Sequence
  Synthetic
uuuaagcgcuuccggucagtt

SEQ ID NO: 1226 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
cugaccggaagcgcuuaaatt

SEQ ID NO: 1227 - DNA, 21 bp, Artificial Sequence
  Synthetic
  misc_feature (4)..(5): 2'-Fluoro
  misc_feature (18)..(18): 2'-Fluoro
uuuaagcgcuuccggucagtt

SEQ ID NO: 1228 - DNA, 21 bp, Artificial Sequence
  Synthetic
  misc_feature (2)..(2): 2'-Fluoro
  misc_feature (11)..(11): 2'-Fluoro
  misc_feature (16)..(16): 2'-Fluoro
cugaccggaagcgcuuaaatt

SEQ ID NO: 1229 - DNA, 21 bp, Artificial Sequence
  Synthetic
  misc_feature (3)..(3): 2'-Fluoro
  misc_feature (17)..(17): 2'-Fluoro
uuuaagcgcuuccggucagtt

SEQ ID NO: 1230 - DNA, 21 bp, Artificial Sequence
  Synthetic
  misc_feature (2)..(2): 2'-Fluoro
cugaccggaagcgcuuaaatt

SEQ ID NO: 1231 - DNA, 21 bp, Artificial Sequence
  Synthetic
  misc_feature (3)..(3): 2'-Fluoro
uuuaagcgcuuccggucagtt

SEQ ID NO: 1232 - DNA, 21 bp, Artificial Sequence
  Synthetic
gaagagccuacacaacccutt

SEQ ID NO: 1233 - DNA, 21 bp, Artificial Sequence
  Synthetic
aggguuguguaggcucuuctt

SEQ ID NO: 1234 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gaagagccuacacaacccutt

SEQ ID NO: 1235 - DNA, 21 bp, Artificial Sequence
  Synthetic
  misc_feature (2)..(4): 2'-O-Methyl
  misc_feature (7)..(7): 2'-O-Methyl
  misc_feature (9)..(9): 2'-O-Methyl
  misc_feature (12)..(13): 2'-O-Methyl
aggguuguguaggcucuuctt

SEQ ID NO: 1236 - DNA, 21 bp, Artificial Sequence
  Synthetic
  misc_feature (9)..(11): 2'-O-Methyl
  misc_feature (13)..(13): 2'-O-Methyl
gaagagccuacacaacccutt

SEQ ID NO: 1237 - DNA, 21 bp, Artificial Sequence
  Synthetic
  misc_feature (6)..(6): 2'-O-Methyl
  misc_feature (8)..(8): 2'-O-Methyl
  misc_feature (10)..(10): 2'-O-Methyl
aggguuguguaggcucuuctt

SEQ ID NO: 1238 - DNA, 21 bp, Artificial Sequence
  Synthetic
  misc_feature (11)..(11): 2'-O-Methyl
  misc_feature (13)..(13): 2'-O-Methyl
gaagagccuacacaacccutt

SEQ ID NO: 1239 - DNA, 21 bp, Artificial Sequence
  Synthetic
  misc_feature (6)..(6): 2'-O-Methyl
  misc_feature (10)..(10): 2'-O-Methyl
aggguuguguaggcucuuctt

SEQ ID NO: 1240 - DNA, 21 bp, Artificial Sequence
  Synthetic
acagaaagaguucgaggagtt

SEQ ID NO: 1241 - DNA, 21 bp, Artificial Sequence
  Synthetic
cuccucgaacucuuucugutt

SEQ ID NO: 1242 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
acagaaagaguucgaggagtt

SEQ ID NO: 1243 - DNA, 21 bp, Artificial Sequence
  Synthetic
  misc_feature (7)..(7): 2'-O-Methyl
  misc_feature (18)..(18): 2'-O-Methyl
cuccucgaacucuuucugutt

SEQ ID NO: 1244 - DNA, 21 bp, Artificial Sequence
  Synthetic
  misc_feature (2)..(3): 2'-O-Methyl
  misc_feature (9)..(9): 2'-O-Methyl
acagaaagaguucgaggagtt

SEQ ID NO: 1245 - DNA, 21 bp, Artificial Sequence
  Synthetic
  misc_feature (17)..(17): 2'-O-Methyl
cuccucgaacucuuucugutt

SEQ ID NO: 1246 - DNA, 21 bp, Artificial Sequence
  Synthetic
  misc_feature (2)..(2): 2'-O-Methyl
acagaaagaguucgaggagtt

SEQ ID NO: 1247 - DNA, 21 bp, Artificial Sequence
  Synthetic
  misc_feature (17)..(17): 2'-O-Methyl
cuccucgaacucuuucugutt

SEQ ID NO: 1248 - DNA, 21 bp, Artificial Sequence
  Synthetic
aggagaccgugacauuucgtt

SEQ ID NO: 1249 - DNA, 21 bp, Artificial Sequence
  Synthetic
cgaaaugucacggucuccutt

SEQ ID NO: 1250 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
aggagaccgugacauuucgtt

SEQ ID NO: 1251 - DNA, 21 bp, Artificial Sequence
  Synthetic
  misc_feature (2)..(2): 2'-Fluoro
  misc_feature (7)..(7): 2'-Fluoro
  misc_feature (12)..(13): 2'-Fluoro
cgaaaugucacggucuccutt

SEQ ID NO: 1252 - DNA, 21 bp, Artificial Sequence
  Synthetic
  misc_feature (10)..(10): 2'-Fluoro
  misc_feature (13)..(13): 2'-Fluoro
aggagaccgugacauuucgtt

SEQ ID NO: 1253 - DNA, 21 bp, Artificial Sequence
  Synthetic
  misc_feature (6)..(6): 2'-Fluoro
  misc_feature (9)..(10): 2'-Fluoro
cgaaaugucacggucuccutt

SEQ ID NO: 1254 - DNA, 21 bp, Artificial Sequence
  Synthetic
  misc_feature (10)..(10): 2'-Fluoro
  misc_feature (13)..(13): 2'-Fluoro
aggagaccgugacauuucgtt

SEQ ID NO: 1255 - DNA, 21 bp, Artificial Sequence
  Synthetic
  misc_feature (6)..(6): 2'-Fluoro
cgaaaugucacggucuccutt

SEQ ID NO: 1256 - DNA, 21 bp, Artificial Sequence
  Synthetic
accuuaaggaccaccggautt

SEQ ID NO: 1257 - DNA, 21 bp, Artificial Sequence
  Synthetic
auccggugguccuuaaggutt

SEQ ID NO: 1258 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
accuuaaggaccaccggautt

SEQ ID NO: 1259 - DNA, 21 bp, Artificial Sequence
  Synthetic
  misc_feature (1)..(1): 2'-Fluoro
  misc_feature (15)..(16): 2'-Fluoro
auccggugguccuuaaggutt

SEQ ID NO: 1260 - DNA, 21 bp, Artificial Sequence
  Synthetic
  misc_feature (5)..(5): 2'-Fluoro
  misc_feature (12)..(13): 2'-Fluoro
accuuaaggaccaccggautt

SEQ ID NO: 1261 - DNA, 21 bp, Artificial Sequence
  Synthetic
  misc_feature (7)..(7): 2'-Fluoro
  misc_feature (14)..(15): 2'-Fluoro
auccggugguccuuaaggutt

SEQ ID NO: 1262 - DNA, 21 bp, Artificial Sequence
  Synthetic
  misc_feature (5)..(5): 2'-Fluoro
accuuaaggaccaccggautt

SEQ ID NO: 1263 - DNA, 21 bp, Artificial Sequence
  Synthetic
  misc_feature (7)..(7): 2'-Fluoro
auccggugguccuuaaggutt

SEQ ID NO: 1264 - DNA, 21 bp, Artificial Sequence
  Synthetic
cggaucuacaccuucaagatt

SEQ ID NO: 1265 - DNA, 21 bp, Artificial Sequence
  Synthetic
ucuugaagguguagauccgtt

SEQ ID NO: 1266 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
cggaucuacaccuucaagatt

SEQ ID NO: 1267 - DNA, 21 bp, Artificial Sequence
  Synthetic
  misc_feature (1)..(1): 2'-O-Methyl
  misc_feature (3)..(4): 2'-O-Methyl
  misc_feature (10)..(10): 2'-O-Methyl
  misc_feature (12)..(12): 2'-O-Methyl
  misc_feature (16)..(16): 2'-O-Methyl
ucuugaagguguagauccgtt

SEQ ID NO: 1268 - DNA, 21 bp, Artificial Sequence
  Synthetic
  misc_feature (7)..(9): 2'-O-Methyl
  misc_feature (15)..(15): 2'-O-Methyl
cggaucuacaccuucaagatt

SEQ ID NO: 1269 - DNA, 21 bp, Artificial Sequence
  Synthetic
  misc_feature (4)..(4): 2'-O-Methyl
  misc_feature (10)..(10): 2'-O-Methyl
  misc_feature (12)..(12): 2'-O-Methyl
ucuugaagguguagauccgtt

SEQ ID NO: 1270 - DNA, 21 bp, Artificial Sequence
  Synthetic
  misc_feature (7)..(7): 2'-O-Methyl
  misc_feature (16)..(16): 2'-O-Methyl
cggaucuacaccuucaagatt

SEQ ID NO: 1271 - DNA, 21 bp, Artificial Sequence
  Synthetic
  misc_feature (10)..(10): 2'-O-Methyl
ucuugaagguguagauccgtt

SEQ ID NO: 1272 - DNA, 21 bp, Artificial Sequence
  Synthetic
gcuuuaaggaacuggaaggtt

SEQ ID NO: 1273 - DNA, 21 bp, Artificial Sequence
  Synthetic
ccuuccaguuccuuaaagctt

SEQ ID NO: 1274 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gcuuuaaggaacuggaaggtt

SEQ ID NO: 1275 - DNA, 21 bp, Artificial Sequence
  Synthetic
  misc_feature (8)..(8): 2'-O-Methyl
  misc_feature (18)..(18): 2'-O-Methyl
ccuuccaguuccuuaaagctt

SEQ ID NO: 1276 - DNA, 21 bp, Artificial Sequence
  Synthetic
  misc_feature (5)..(6): 2'-O-Methyl
  misc_feature (13)..(13): 2'-O-Methyl
gcuuuaaggaacuggaaggtt

SEQ ID NO: 1277 - DNA, 21 bp, Artificial Sequence
  Synthetic
  misc_feature (6)..(6): 2'-O-Methyl
  misc_feature (14)..(15): 2'-O-Methyl
ccuuccaguuccuuaaagctt

SEQ ID NO: 1278 - DNA, 21 bp, Artificial Sequence
  Synthetic
  misc_feature (6)..(6): 2'-O-Methyl
  misc_feature (13)..(13): 2'-O-Methyl
gcuuuaaggaacuggaaggtt

SEQ ID NO: 1279 - DNA, 21 bp, Artificial Sequence
  Synthetic
  misc_feature (6)..(6): 2'-O-Methyl
ccuuccaguuccuuaaagctt

SEQ ID NO: 1280 - DNA, 21 bp, Artificial Sequence
  Synthetic
gagagagacgguggaagaatt

SEQ ID NO: 1281 - DNA, 21 bp, Artificial Sequence
  Synthetic
uucuuccaccgucucucuctt

SEQ ID NO: 1282 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
gagagagacgguggaagaatt

SEQ ID NO: 1283 - DNA, 21 bp, Artificial Sequence
  Synthetic
  misc_feature (11)..(11): 2'-O-Methyl
uucuuccaccgucucucuctt

SEQ ID NO: 1284 - DNA, 21 bp, Artificial Sequence
  Synthetic
  misc_feature (12)..(13): 2'-O-Methyl
gagagagacgguggaagaatt

SEQ ID NO: 1285 - DNA, 21 bp, Artificial Sequence
  Synthetic
  misc_feature (7)..(7): 2'-O-Methyl
uucuuccaccgucucucuctt

SEQ ID NO: 1286 - DNA, 21 bp, Artificial Sequence
  Synthetic
  misc_feature (8)..(8): 2'-O-Methyl
uucuuccaccgucucucuctt

SEQ ID NO: 1287 - DNA, 21 bp, Artificial Sequence
  Synthetic
auccugcagaagaagccuctt

SEQ ID NO: 1288 - DNA, 21 bp, Artificial Sequence
  Synthetic
gaggcuucuucugcaggautt

SEQ ID NO: 1289 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
auccugcagaagaagccuctt

SEQ ID NO: 1290 - DNA, 21 bp, Artificial Sequence
  Synthetic
  misc_feature (5)..(5): 2'-O-Methyl
  misc_feature (8)..(8): 2'-O-Methyl
  misc_feature (11)..(11): 2'-O-Methyl
  misc_feature (14)..(14): 2'-O-Methyl
gaggcuucuucugcaggautt

SEQ ID NO: 1291 - DNA, 21 bp, Artificial Sequence
  Synthetic
  misc_feature (5)..(5): 2'-O-Methyl
  misc_feature (7)..(7): 2'-O-Methyl
  misc_feature (15)..(15): 2'-O-Methyl
auccugcagaagaagccuctt

SEQ ID NO: 1292 - DNA, 21 bp, Artificial Sequence
  Synthetic
  misc_feature (12)..(12): 2'-O-Methyl
  misc_feature (14)..(14): 2'-O-Methyl
gaggcuucuucugcaggautt

SEQ ID NO: 1293 - DNA, 21 bp, Artificial Sequence
  Synthetic
  misc_feature (5)..(5): 2'-O-Methyl
  misc_feature (7)..(7): 2'-O-Methyl
auccugcagaagaagccuctt

SEQ ID NO: 1294 - DNA, 21 bp, Artificial Sequence
  Synthetic
uccucgucgucuguucuaatt

SEQ ID NO: 1295 - DNA, 21 bp, Artificial Sequence
  Synthetic
uuagaacagacgacgaggatt

SEQ ID NO: 1296 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uccucgucgucuguucuaatt

SEQ ID NO: 1297 - DNA, 21 bp, Artificial Sequence
  Synthetic
  misc_feature (7)..(7): 2'-Fluoro
  misc_feature (11)..(11): 2'-Fluoro
  misc_feature (14)..(14): 2'-Fluoro
uuagaacagacgacgaggatt

SEQ ID NO: 1298 - DNA, 21 bp, Artificial Sequence
  Synthetic
  misc_feature (9)..(9): 2'-Fluoro
  misc_feature (12)..(13): 2'-Fluoro
  misc_feature (17)..(17): 2'-Fluoro
uccucgucgucuguucuaatt

SEQ ID NO: 1299 - DNA, 21 bp, Artificial Sequence
  Synthetic
  misc_feature (2)..(2): 2'-Fluoro
  misc_feature (7)..(7): 2'-Fluoro
uuagaacagacgacgaggatt

SEQ ID NO: 1300 - DNA, 21 bp, Artificial Sequence
  Synthetic
  misc_feature (17)..(17): 2'-Fluoro
uccucgucgucuguucuaatt

SEQ ID NO: 1301 - DNA, 21 bp, Artificial Sequence
  Synthetic
  misc_feature (2)..(2): 2'-Fluoro
  misc_feature (7)..(7): 2'-Fluoro
uuagaacagacgacgaggatt

SEQ ID NO: 1302 - RNA, 21 nt, Artificial Sequence
  Synthetic
aacccaccacagcuagaacuu

SEQ ID NO: 1303 - RNA, 21 nt, Artificial Sequence
  Synthetic
guucuagcugugguggguuuu

SEQ ID NO: 1304 - RNA, 21 nt, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
aacccaccacagcuagaacuu

SEQ ID NO: 1305 - RNA, 21 nt, Artificial Sequence
  Synthetic
  misc_feature (1)..(1): 2'-Fluoro
  misc_feature (7)..(7): 2'-Fluoro
  misc_feature (10)..(10): 2'-Fluoro
  misc_feature (12)..(13): 2'-Fluoro
  misc_feature (15)..(17): 2'-Fluoro
guucuagcugugguggguuuu

SEQ ID NO: 1306 - RNA, 21 nt, Artificial Sequence
  Synthetic
  misc_feature (5)..(5): 2'-Fluoro
  misc_feature (10)..(10): 2'-Fluoro
  misc_feature (14)..(14): 2'-Fluoro
aacccaccacagcuagaacuu

SEQ ID NO: 1307 - RNA, 21 nt, Artificial Sequence
  Synthetic
  misc_feature (5)..(5): 2'-Fluoro
  misc_feature (9)..(9): 2'-Fluoro
  misc_feature (11)..(11): 2'-Fluoro
  misc_feature (14)..(14): 2'-Fluoro
guucuagcugugguggguuuu

SEQ ID NO: 1308 - RNA, 21 nt, Artificial Sequence
  Synthetic
  misc_feature (5)..(5): 2'-Fluoro
  misc_feature (14)..(14): 2'-Fluoro
aacccaccacagcuagaacuu

SEQ ID NO: 1309 - RNA, 21 nt, Artificial Sequence
  Synthetic
  misc_feature (9)..(9): 2'-Fluoro
guucuagcugugguggguuuu

SEQ ID NO: 1310 - DNA, 21 bp, Artificial Sequence
  Synthetic
uuacaaaggaucuccuccctt

SEQ ID NO: 1311 - DNA, 21 bp, Artificial Sequence
  Synthetic
gggaggagauccuuuguaatt

SEQ ID NO: 1312 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
uuacaaaggaucuccuccctt

SEQ ID NO: 1313 - DNA, 21 bp, Artificial Sequence
  Synthetic
  misc_feature (4)..(4): 2'-O-Methyl
  misc_feature (7)..(7): 2'-O-Methyl
  misc_feature (9)..(9): 2'-O-Methyl
  misc_feature (18)..(19): 2'-O-Methyl
gggaggagauccuuuguaatt

SEQ ID NO: 1314 - DNA, 21 bp, Artificial Sequence
  Synthetic
  misc_feature (2)..(2): 2'-O-Methyl
  misc_feature (4)..(4): 2'-O-Methyl
  misc_feature (8)..(9): 2'-O-Methyl
uuacaaaggaucuccuccctt

SEQ ID NO: 1315 - DNA, 21 bp, Artificial Sequence
  Synthetic
  misc_feature (15)..(15): 2'-O-Methyl
  misc_feature (17)..(17): 2'-O-Methyl
gggaggagauccuuuguaatt

SEQ ID NO: 1316 - DNA, 21 bp, Artificial Sequence
  Synthetic
  misc_feature (3)..(4): 2'-O-Methyl
uuacaaaggaucuccuccctt

SEQ ID NO: 1317 - DNA, 21 bp, Artificial Sequence
  Synthetic
  misc_feature (17)..(17): 2'-O-Methyl
gggaggagauccuuuguaatt

SEQ ID NO: 1318 - DNA, 21 bp, Artificial Sequence
  Synthetic
aaacgagagagcccaccuutt

SEQ ID NO: 1319 - DNA, 21 bp, Artificial Sequence
  Synthetic
aaggugggcucucucguuutt

SEQ ID NO: 1320 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaacgagagagcccaccuutt

SEQ ID NO: 1321 - DNA, 21 bp, Artificial Sequence
  Synthetic
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
aaggugggcucucucguuutt

SEQ ID NO: 1322 - DNA, 21 bp, Artificial Sequence
  Synthetic
  misc_feature (7)..(7): 2'-O-Methyl
  misc_feature (14)..(14): 2'-O-Methyl
aaacgagagagcccaccuutt

SEQ ID NO: 1323 - DNA, 21 bp, Artificial Sequence
  Synthetic
  misc_feature (5)..(6): 2'-O-Methyl
aaggugggcucucucguuutt

SEQ ID NO: 1324 - DNA, 21 bp, Artificial Sequence
  Synthetic
  misc_feature (5)..(5): 2'-O-Methyl
aaggugggcucucucguuutt

SEQ ID NO: 1325 - DNA, 21 bp, Artificial Sequence
  Synthetic
aaagcgguggaucagcucutt

SEQ ID NO: 1326 - DNA, 21 bp, Artificial Sequence
  Synthetic
agagcugauccaccgcuuutt

SEQ ID NO: 1327 - DNA, 21 bp, Artificial Sequence
  Synthetic
  misc_feature (1)..(1): 2'-O-Methyl
  misc_feature (3)..(3): 2'-O-Methyl
  misc_feature (5)..(5): 2'-O-Methyl
  misc_feature (7)..(7): 2'-O-Methyl
  misc_feature (9)..(9): 2'-O-Methyl
  misc_feature (11)..(11): 2'-O-Methyl
  misc_feature (13)..(13): 2'-O-Methyl
  misc_feature (15)..(15): 2'-O-Methyl
  misc_feature (17)..(17): 2'-O-Methyl
  misc_feature (19)..(19): 2'-O-Methyl
aaagcgguggaucagcucutt

SEQ ID NO: 1328 - DNA, 21 bp, Artificial Sequence
  Synthetic
  misc_feature (2)..(2): 2'-O-Methyl
  misc_feature (4)..(4): 2'-O-Methyl
agagcugauccaccgcuuutt

SEQ ID NO: 1329 - DNA, 21 bp, Artificial Sequence
  Synthetic
  misc_feature (8)..(9): 2'-O-Methyl
  misc_feature (13)..(13): 2'-O-Methyl
aaagcgguggaucagcucutt

SEQ ID NO: 1330 - DNA, 21 bp, Artificial Sequence
  Synthetic
  misc_feature (6)..(6): 2'-O-Methyl
  misc_feature (11)..(12): 2'-O-Methyl
agagcugauccaccgcuuutt

SEQ ID NO: 1331 - DNA, 21 bp, Artificial Sequence
  Synthetic
  misc_feature (6)..(6): 2'-O-Methyl
  misc_feature (11)..(11): 2'-O-Methyl
agagcugauccaccgcuuutt

SEQ ID NO: 1332 - DNA, 21 bp, Artificial Sequence
  Synthetic
uccaagcuuccucguuggutt

SEQ ID NO: 1333 - DNA, 21 bp, Artificial Sequence
  Synthetic
accaacgaggaagcuuggatt

SEQ ID NO: 1334 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
uccaagcuuccucguuggutt

SEQ ID NO: 1335 - DNA, 21 bp, Artificial Sequence
  Synthetic
  misc_feature (15)..(16): 2'-Fluoro
accaacgaggaagcuuggatt

SEQ ID NO: 1336 - DNA, 21 bp, Artificial Sequence
  Synthetic
  misc_feature (3)..(3): 2'-Fluoro
  misc_feature (16)..(17): 2'-Fluoro
uccaagcuuccucguuggutt

SEQ ID NO: 1337 - DNA, 21 bp, Artificial Sequence
  Synthetic
  misc_feature (3)..(4): 2'-Fluoro
  misc_feature (16)..(16): 2'-Fluoro
accaacgaggaagcuuggatt

SEQ ID NO: 1338 - DNA, 21 bp, Artificial Sequence
  Synthetic
  misc_feature (3)..(3): 2'-Fluoro
  misc_feature (16)..(16): 2'-Fluoro
accaacgaggaagcuuggatt

SEQ ID NO: 1339 - DNA, 21 bp, Artificial Sequence
  Synthetic
agagagguggagguaucuctt

SEQ ID NO: 1340 - DNA, 21 bp, Artificial Sequence
  Synthetic
gagauaccuccaccucucutt

SEQ ID NO: 1341 - DNA, 21 bp, Artificial Sequence
  Synthetic
  misc_feature (1)..(1): 2'-Fluoro
  misc_feature (3)..(3): 2'-Fluoro
  misc_feature (5)..(5): 2'-Fluoro
  misc_feature (7)..(7): 2'-Fluoro
  misc_feature (9)..(9): 2'-Fluoro
  misc_feature (11)..(11): 2'-Fluoro
  misc_feature (13)..(13): 2'-Fluoro
  misc_feature (15)..(15): 2'-Fluoro
  misc_feature (17)..(17): 2'-Fluoro
  misc_feature (19)..(19): 2'-Fluoro
agagagguggagguaucuctt

SEQ ID NO: 1342 - DNA, 21 bp, Artificial Sequence
  Synthetic
  misc_feature (2)..(2): 2'-Fluoro
  misc_feature (4)..(4): 2'-Fluoro
  misc_feature (6)..(6): 2'-Fluoro
  misc_feature (12)..(12): 2'-Fluoro
gagauaccuccaccucucutt

SEQ ID NO: 1343 - DNA, 21 bp, Artificial Sequence
  Synthetic
  misc_feature (8)..(8): 2'-Fluoro
agagagguggagguaucuctt

SEQ ID NO: 1344 - DNA, 21 bp, Artificial Sequence
  Synthetic
  misc_feature (5)..(5): 2'-Fluoro
gagauaccuccaccucucutt

SEQ ID NO: 1345 - DNA, 21 bp, Artificial Sequence
  Synthetic
ccgaagacgaagcuaugaatt

SEQ ID NO: 1346 - DNA, 21 bp, Artificial Sequence
  Synthetic
uucauagcuucgucuucggtt

SEQ ID NO: 1347 - DNA, 21 bp, Artificial Sequence
  Synthetic
  misc_feature (14)..(14): 2'-O-Methyl
ccgaagacgaagcuaugaatt

SEQ ID NO: 1348 - DNA, 21 bp, Artificial Sequence
  Synthetic
  misc_feature (3)..(3): 2'-O-Methyl
uucauagcuucgucuucggtt

SEQ ID NO: 1349 - RNA, 24 nt, Artificial Sequence
  Synthetic
  misc_feature (24)..(24): 2'-O-Methyl
agcgcuuaaagggcgagaagauun

SEQ ID NO: 1350 - RNA, 26 nt, Artificial Sequence
  Synthetic
  misc_feature (1)..(3): 2'-O-Methyl
nnnucuucucgcccuuuaagcgcuuu

SEQ ID NO: 1351 - RNA, 24 nt, Artificial Sequence
  Synthetic
  misc_feature (1)..(3): 2'-O-Methyl
  misc_feature (5)..(5): 2'-O-Methyl
  misc_feature (8)..(9): 2'-O-Methyl
  misc_feature (11)..(11): 2'-O-Methyl
  misc_feature (14)..(14): 2'-O-Methyl
  misc_feature (17)..(17): 2'-O-Methyl
  misc_feature (23)..(24): 2'-O-Methyl
uuaaugcuaaucgugauagggguu

SEQ ID NO: 1352 - DNA, 21 bp, Artificial Sequence
  Synthetic
  misc_feature (19)..(19): 2'-O-Methyl
gaggaggaggagcagcgautt

SEQ ID NO: 1353 - DNA, 21 bp, Artificial Sequence
  Synthetic
  misc_feature (8)..(8): 2'-O-Methyl
  misc_feature (14)..(14): 2'-O-Methyl
  misc_feature (18)..(18): 2'-O-Methyl
agagagguggagguaucuctt

SEQ ID NO: 1354 - DNA, 21 bp, Artificial Sequence
  Synthetic
  misc_feature (5)..(5): 2'-O-Methyl
  misc_feature (11)..(12): 2'-O-Methyl
gagauaccuccaccucucutt

SEQ ID NO: 1355 - DNA, 21 bp, Artificial Sequence
  Synthetic
  misc_feature (10)..(11): 2'-O-Methyl
  misc_feature (14)..(14): 2'-O-Methyl
  misc_feature (16)..(16): 2'-O-Methyl
ccgaagacgaagcuaugaatt

The invention claimed is:

1. A modified oligonucleotide comprising a first nucleic acid fragment and a second nucleic acid fragment, wherein
   each of said first nucleic acid fragment and said second nucleic acid fragment is 18 to 30 nucleotides in length;
   said first nucleic acid fragment and said second nucleic acid fragment can form double-stranded region;
   said first nucleic acid fragment contains at least one contiguous CA or UG sequence, said second nucleic acid fragment contains at least one contiguous CA or UG sequence complementary to the CA or UG sequence in said first nucleic acid fragment, the CA or UG sequence(s) of said first nucleic acid fragment and the CA or UG sequence(s) of said second nucleic acid fragment pair to form CA/UG and/or UG/CA site(s); wherein at least one of the nucleotides in at least one of the CA/UG and/or UG/CA site(s) is a modified nucleotide; wherein all other nucleotides are unmodified nucleotides; and
   said modified nucleotide(s) providing improved stability of said modified oligonucleotide in mammalian serum compared to stability of an unmodified oligonucleotide.

2. The modified oligonucleotide of claim 1, wherein said oligonucleotide contains at least one CA/UG and/or UG/CA site(s).

3. The modified oligonucleotide of claim 1, wherein only cytidine nucleotide(s) in all occurrences of the CA/UG or UG/CA site is/are modified nucleotide(s).

4. The modified oligonucleotide of claim 1, wherein only one cytidine nucleotide in the CA/UG or UG/CA site(s) is modified nucleotide.

5. The modified oligonucleotide of claim 1, wherein the first nucleic acid fragment and the second nucleic acid fragment are in two separate nucleic acid strands or in a single nucleic acid strand.

6. The modified oligonucleotide of claim 1, wherein the modified oligonucleotide is a hairpin-structured and single-stranded nucleic acid molecule, the complementary nucleic acid sequences of the first nucleic acid fragment and the second nucleic acid fragment pair to form double-stranded region.

7. The modified oligonucleotide of claim 5, wherein the modified oligonucleotide contains a sense strand and an antisense strand, the sense strand and the antisense strand are contiguous nucleic acid fragments; the first nucleic acid fragment is in the sense strand, and the second nucleic acid fragment is in the antisense strand.

8. The modified oligonucleotide of claim 5, wherein the modified oligonucleotide contains a sense strand and an antisense strand, the sense strand contains two or more discontiguous sense-strand component fragments, the antisense strand is a contiguous nucleic acid fragment; the first nucleic acid fragment is in one or more sense-strand component fragments, the second nucleic acid fragment is in the antisense strand.

9. The modified oligonucleotide of claim 1, wherein the modified oligonucleotide is a hybrid nucleic acid molecule comprising ribonucleotides and at least one deoxyribonucleotide.

10. The modified oligonucleotide of claim 1, wherein the modified oligonucleotide has at least one of the following modifications:
    (a) modifying the phosphodiester bond(s) connecting nucleotides in the oligonucleotide;
    (b) modifying the sugar(s) of the nucleotide in the oligonucleotide;
    (c) modifying the base(s) of the nucleotide in the oligonucleotide.

11. The modified oligonucleotide of claim 10, wherein the modification is replacing a 2'-OH group on the sugar with a 2'-modified nucleotide.

12. The modified oligonucleotide of claim 11, wherein the modification is replacing a 2'-OH group on the sugar with a 2'-O-methyl group or a 2'-deoxy-2'-fluoro group.

13. A pharmaceutical composition for inhibiting the expression of a target gene in a mammal, wherein the pharmaceutical composition comprises at least one modified oligonucleotide of claim 1, and a pharmaceutically acceptable carrier.

14. A method for preparing the pharmaceutical composition of claim 13 comprising formulating the oligonucleotide of claim 1 and a pharmaceutically acceptable carrier.

15. A method for inhibiting the expression of a target gene in a cell, comprising:
    (a) introducing the oligonucleotide of claim 1 into the cell; and
    (b) incubating the cell for a time sufficient to obtain inhibition of the expression of the target gene in the cell.

16. The method of claim 15, wherein the cell is a mammalian cell.

17. A method for preparing an oligonucleotide that is highly stable in a biological sample and can inhibit the expression of a target gene, comprising:
    (a) selecting one or more nucleic acid sequences of between 18 and 30 nucleotides in length from the nucleotide sequence of the mRNA resulting from the transcription of the target gene; and
    (b) synthesizing the selected sequences, wherein one strand comprises a sequence complementary to selected sequence in (a); and
    (c) testing one or more oligonucleotides of (b) for their activity to inhibit the expression of the target gene in a biological sample; and
    (d) selecting one or more oligonucleotides of (c) possessing the activity to inhibit the expression of the target gene in a biological sample; and
    (e) in the oligonucleotides selected in (d), identifying in the nucleotide sequences of all occurrences of the CA/UG and UG/CA site(s); and
    (f) synthesizing one or more oligonucleotides selected in (d), wherein at least one nucleotide in the CA/UG and UG/CA site(s) identified in (e) is replaced by a corresponding modified nucleotide;
    wherein only cytidine nucleotide(s) in all occurrences of the CA/UG or UG/CA site is/are modified, and wherein all the nucleotides are unmodified nucleotides except the nucleotides in said CA/UG and/or UG/CA site(s).

18. A method of inhibiting expression of a target gene in a subject, said method comprises administering to a said subject a pharmaceutical composition comprising the oligonucleotide of claim 1 and a pharmaceutically acceptable carrier, wherein the target gene is sufficiently complementary to hybridize to the oligonucleotide of claim 1 and inhibit expression.

19. The method of claim 18, wherein the subject is a human being.

20. A method for preparing an oligonucleotide with nuclease resistance, said method comprising the steps of:
    (a) identifying in the nucleotide sequence of the oligonucleotide all occurrences of CA/UG and UG/CA site(s); and
    (b) synthesizing the oligonucleotide, wherein at least one nucleotide in the CA/UG and UG/CA site(s) identified in (a) is replaced by a modified corresponding nucleotide;
    wherein only cytidine nucleotide(s) in all occurrences of CA/UG or UG/CA site is/are modified, and wherein all the nucleotides are unmodified nucleotides except the nucleotides in said CA/UG and/or UG/CA site(s).

21. A method to identify an oligonucleotide with stability in biological samples, comprising the steps of:
    (a) providing a first modified oligonucleotide of claim 1, and a second oligonucleotide identical in sequence to the first oligonucleotide except that it does not have modified nucleotide(s) of the oligonucleotide of claim 1; and
    (b) determining the stability and the degradation process of said first and second oligonucleotide in a biological sample by contacting the two oligonucleotides with the biological sample under identical conditions,
    whereby, where the first modified oligonucleotide is degraded less rapidly than the second oligonucleotide, an oligonucleotide with stability in a biological sample is identified.

22. The modified oligonucleotide of claim 1, wherein the first nucleic acid fragment contains at least one contiguous UA sequence and at least one contiguous CA or UG sequence, the second nucleic acid fragment contains at least one contiguous UA sequence complementary to the UA sequence of the first nucleic acid fragment and one contiguous CA or UG sequence complementary to the CA or UG sequence of the first nucleic acid fragment, the UA sequence(s) of the first nucleic acid fragment and the UA sequence(s) of the second nucleic acid fragment pair to form UA/UA site(s), the CA or UG sequence(s) of the first nucleic acid fragment and the UG or CA sequence(s) of the second nucleic acid fragment pair to form CA/UG or UG/CA site(s); wherein at least one of the nucleotides in at least one of the UA/UA site(s) is a modified nucleotide, and at least one of the nucleotides in at least one of the CA/UG or UG/CA site(s) is a modified nucleotide.

23. The modified oligonucleotide of claim 22, wherein at least one uridine nucleotide in the UG/CA site(s) is modified nucleotide.

* * * * *